US011739308B2

(12) United States Patent
Cox et al.

(10) Patent No.: US 11,739,308 B2
(45) Date of Patent: Aug. 29, 2023

(54) CAS13B ORTHOLOGUES CRISPR ENZYMES AND SYSTEMS

(71) Applicants: The Broad Institute, Inc., Cambridge, MA (US); Massachusetts Institute of Technology, Cambridge, MA (US)

(72) Inventors: David Benjamin Turitz Cox, Cambridge, MA (US); Neena Pyzocha, Cambridge, MA (US); Feng Zhang, Cambridge, MA (US)

(73) Assignees: The Broad Institute, Inc., Cambridge, MA (US); Massachusetts Institute of Technology, Cambridge, MA (US)

(*) Notice: Subject to any disclaimer, the term of this patent is extended or adjusted under 35 U.S.C. 154(b) by 118 days.

(21) Appl. No.: 16/493,464

(22) PCT Filed: Mar. 15, 2018

(86) PCT No.: PCT/US2018/022751
§ 371 (c)(1),
(2) Date: Sep. 12, 2019

(87) PCT Pub. No.: WO2018/170333
PCT Pub. Date: Sep. 20, 2018

(65) Prior Publication Data
US 2020/0131488 A1    Apr. 30, 2020

Related U.S. Application Data

(60) Provisional application No. 62/566,829, filed on Oct. 2, 2017, provisional application No. 62/471,710, filed on Mar. 15, 2017.

(51) Int. Cl.
C12N 9/22         (2006.01)
C12N 15/86        (2006.01)
(52) U.S. Cl.
CPC .............. *C12N 9/22* (2013.01); *C12N 15/86* (2013.01); *C12N 2310/20* (2017.05); *C12N 2800/30* (2013.01)
(58) Field of Classification Search
None
See application file for complete search history.

(56) References Cited

U.S. PATENT DOCUMENTS

| 4,873,316 A | 10/1989 | Meade et al. |
| 5,543,158 A | 8/1996 | Gref et al. |
| 5,563,055 A | 10/1996 | Townsend et al. |
| 5,580,859 A | 12/1996 | Felgner et al. |
| 5,589,466 A | 12/1996 | Felgner et al. |
| 5,593,972 A | 1/1997 | Weiner et al. |
| 5,846,946 A | 12/1998 | Huebner et al. |
| 5,855,913 A | 1/1999 | Hanes et al. |
| 5,985,309 A | 11/1999 | Edwards et al. |
| 6,007,845 A | 12/1999 | Domb et al. |
| 6,750,059 B1 | 6/2004 | Blakesley et al. |
| 7,259,015 B2 | 8/2007 | Kingsman et al. |
| 7,303,910 B2 | 12/2007 | Bebbington et al. |
| 7,351,585 B2 | 4/2008 | Mitrophanous et al. |
| 7,745,651 B2 | 6/2010 | Heyes et al. |
| 7,776,321 B2 | 8/2010 | Cascalho et al. |
| 7,799,565 B2 | 9/2010 | MacLachlan et al. |
| 7,803,397 B2 | 9/2010 | Heyes et al. |
| 7,838,658 B2 | 11/2010 | MacLachlan et al. |
| 7,901,708 B2 | 3/2011 | MacLachlan et al. |
| 7,915,399 B2 | 3/2011 | MacLachlan et al. |
| 7,982,027 B2 | 7/2011 | MacLachlan et al. |
| 8,044,019 B2 | 10/2011 | Uno et al. |
| 8,058,069 B2 | 11/2011 | Yaworski et al. |
| 8,101,741 B2 | 1/2012 | MacLachlan et al. |
| 8,188,263 B2 | 5/2012 | MacLachlan et al. |
| 8,236,943 B2 | 8/2012 | Lee et al. |
| 8,283,333 B2 | 10/2012 | Yaworski et al. |
| 8,372,951 B2 | 2/2013 | Chang et al. |
| 8,404,658 B2 | 3/2013 | Hajjar et al. |
| 8,454,972 B2 | 6/2013 | Nabel et al. |
| 8,575,305 B2 | 11/2013 | Gait et al. |
| 8,614,194 B1 | 12/2013 | Chen et al. |
| 8,697,359 B1 | 4/2014 | Zhang |
| 8,709,843 B2 | 4/2014 | Shakuda |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |

(Continued)

FOREIGN PATENT DOCUMENTS

| EP | 0 264 166 A1 | 4/1988 |
| EP | 1 519 714 A1 | 4/2005 |

(Continued)

OTHER PUBLICATIONS

GenPept. Accession No. WP_072319476, Dec. 2016.*
Zhang et al., GenPept Accession No. WP 061868553, Sep. 2020.*
Zhang et al., Cell Research, vol. 28, pp. 1198-1201, 2018.*
The Broad Institute, Inc., "Communication pursuant to Article 94(3) EPC for EP 18715416.6", dated Mar. 30, 2021, 6 pages.
The Broad Institute, Inc., "Notice of Ground for Rejection for Korean Patent Application No. 10-2020-7034051", dated Apr. 30, 2021, 6 pages.
The Broad Institute, Inc., Notification Concerning Transmittal of International Preliminary Report on Patentability for PCT/US2018/022751, dated Sep. 26, 2019, 9 pages.
The Broad Institute, Inc., "First Examination Report for IN 201917040847", dated Nov. 27, 2020, 6 pages.

(Continued)

*Primary Examiner* — Richard G Hutson
(74) *Attorney, Agent, or Firm* — F. Brent Nix, Esq.; Johnson, Marcou, Isaacs & Nix, LL

(57) ABSTRACT

The invention provides for systems, methods, and compositions for targeting nucleic acids. In particular, the invention provides non-naturally occurring or engineered RNA-targeting systems comprising a novel RNA-targeting Cas13b effector protein and at least one targeting nucleic acid component like a guide RNA or crRNA.

10 Claims, 58 Drawing Sheets

Specification includes a Sequence Listing.

(56) References Cited

U.S. PATENT DOCUMENTS

| | | |
|---|---|---|
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 2004/0013648 A1 | 1/2004 | Kingsman et al. |
| 2004/0142476 A1 | 7/2004 | Evans et al. |
| 2004/0171156 A1 | 9/2004 | Hartley et al. |
| 2005/0019923 A1 | 1/2005 | Uchegbu et al. |
| 2006/0281180 A1 | 12/2006 | Radcliffe et al. |
| 2007/0025970 A1 | 2/2007 | Kingsman et al. |
| 2007/0054961 A1 | 3/2007 | Maden et al. |
| 2008/0267903 A1 | 10/2008 | Uchegbu et al. |
| 2009/0007284 A1 | 1/2009 | Radcliffe et al. |
| 2009/0017543 A1 | 1/2009 | Wilkes et al. |
| 2009/0111106 A1 | 4/2009 | Mitrophanous et al. |
| 2010/0317109 A1 | 12/2010 | Maden et al. |
| 2011/0059502 A1 | 3/2011 | Chalasani |
| 2011/0117189 A1 | 5/2011 | Mazzone et al. |
| 2011/0195123 A1 | 8/2011 | Shemi |
| 2011/0265198 A1 | 10/2011 | Gregory et al. |
| 2011/0293571 A1 | 12/2011 | Widdowson et al. |
| 2011/0293703 A1 | 12/2011 | Mahon et al. |
| 2012/0003201 A1 | 1/2012 | Nicholas et al. |
| 2012/0017290 A1 | 1/2012 | Cui et al. |
| 2012/0251560 A1 | 10/2012 | Dahlman et al. |
| 2012/0251618 A1 | 10/2012 | Schrum et al. |
| 2012/0295960 A1 | 11/2012 | Palfi et al. |
| 2013/0185823 A1 | 7/2013 | Kuang et al. |
| 2013/0236946 A1 | 9/2013 | Gouble |
| 2013/0244279 A1 | 9/2013 | De Fougerolles et al. |
| 2013/0245107 A1 | 9/2013 | De Fougerolles et al. |
| 2013/0252281 A1 | 9/2013 | De Fougerolles et al. |
| 2013/0302401 A1 | 11/2013 | Ma et al. |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0287938 A1 | 9/2014 | Zhang et al. |
| 2014/0310830 A1 | 10/2014 | Zhang et al. |
| 2014/0335620 A1 | 11/2014 | Zhang et al. |
| 2014/0357530 A1 | 12/2014 | Zhang et al. |
| 2015/0291966 A1 | 10/2015 | Zhang et al. |
| 2016/0251648 A1 | 9/2016 | Wang et al. |
| 2017/0175144 A1 | 6/2017 | Zhang et al. |
| 2017/0211142 A1 | 7/2017 | Smargon et al. |
| 2017/0349914 A1 | 12/2017 | Cox et al. |
| 2018/0010134 A1 | 1/2018 | Sharp et al. |
| 2018/0044662 A1 | 2/2018 | Platt et al. |
| 2018/0057810 A1 | 3/2018 | Zhang et al. |
| 2018/0066242 A1 | 3/2018 | Zhang et al. |

FOREIGN PATENT DOCUMENTS

| | | | |
|---|---|---|---|
| EP | 1 664 316 A1 | 6/2006 | |
| EP | 1 766 035 A1 | 3/2007 | |
| EP | 1 781 593 A2 | 5/2007 | |
| EP | 2 764 103 A2 | 8/2014 | |
| EP | 2 771 468 A1 | 9/2014 | |
| EP | 2 784 162 A1 | 10/2014 | |
| WO | 91/16024 A1 | 10/1991 | |
| WO | 91/17424 A1 | 11/1991 | |
| WO | 96/39154 A1 | 12/1996 | |
| WO | 97/03211 A1 | 1/1997 | |
| WO | 2004/015075 A2 | 2/2004 | |
| WO | 2008/042156 A1 | 4/2008 | |
| WO | 2008/064289 A2 | 5/2008 | |
| WO | 2010/061186 A2 | 6/2010 | |
| WO | 2010/096488 A1 | 8/2010 | |
| WO | 2011/008730 A2 | 1/2011 | |
| WO | 2012/135025 A2 | 10/2012 | |
| WO | 2014/018423 A2 | 1/2014 | |
| WO | 2014/093595 A1 | 6/2014 | |
| WO | 2014/093622 A2 | 6/2014 | |
| WO | 2014/093635 A1 | 6/2014 | |
| WO | 2014/093655 A2 | 6/2014 | |
| WO | 2014/093661 A2 | 6/2014 | |
| WO | 2014/093694 A1 | 6/2014 | |
| WO | 2014/093701 A1 | 6/2014 | |
| WO | 2014/093709 A1 | 6/2014 | |
| WO | 2014/093712 A1 | 6/2014 | |
| WO | 2014/093718 A1 | 6/2014 | |
| WO | 2014/204723 A1 | 12/2014 | |
| WO | 2014/204724 A1 | 12/2014 | |
| WO | 2014/204725 A1 | 12/2014 | |
| WO | 2014/204726 A1 | 12/2014 | |
| WO | 2014/204727 A1 | 12/2014 | |
| WO | 2014/204728 A1 | 12/2014 | |
| WO | 2014/204729 A1 | 12/2014 | |
| WO | 2015/065964 A1 | 5/2015 | |
| WO | 2015/089419 A2 | 6/2015 | |
| WO | 2017/070605 A1 | 4/2017 | |
| WO | 2017/219027 A1 | 12/2017 | |
| WO | 2018/107103 A1 | 6/2018 | |
| WO | 2018/170333 A1 | 9/2018 | |

OTHER PUBLICATIONS

Hypothetical protein, [Sinomicrobium oceani]—Protein—NCBI, Dec. 17, 2016 (Dec. 17, 2016), XP055487985, 2 pages.
Anonymous, "fig28131.5.peg.280::Feature Overview", Feb. 18, 2017, Retrieved from the Internet: www.patricbrc.org/view/Feature/fig]28131.5.peg.280, 1 page.
Anonymous, "fig1403336.3.peg.1666::Feature Overview", Feb. 18, 2017, Retrieved from the Internet: www.patricbrc.org/view/Feature/fig]1403336.3.peg.1666, 1 page.
Aryn A. Price et al, "Cas9-mediated targeting of viral RNA in eukaryotic cells", Proceedings of the National Academy of Sciences, vol. 112, No. 19, May 12, 2015, p. 6164-6169.
Barrangou et al., "Expanding the CRISPR Toolbox: Targeting RNA with Cas13b," Molecular Cell., vol. 65, pp. 582-584, 2017.
Smargon et al., "Cas13b Is a Type VI-B CRISPR-Associated RNA-Guided RNase Differentially Regulated by Accessory Proteins Csx27 and Csx28," Molecular Cell. 2017, vol. 65, pp. 618-630.
The Broad Institute, Inc., Examination Report No. 1 for Standard Patent Application for AU 2018234825, dated Dec. 5, 2019, 5 pages.
Zheng, et al., "Topical Delivery of siRNA-Based Spherical Nucleic Acid Nanoparticle Conjugates for Gene Regulation", Proceedings of the National Academy of Sciences, vol. 109, No. 30, Jul. 24, 2012, 11975-11980.
Sorensen, et al., "Gene Silencing By Systemic Delivery of Synthetic siRNAs in Adult Mice", Journal of Molecular Biology, vol. 327, Apr. 4, 2003, 761-766.
Spuch, et al., "Liposomes for Targeted Delivery of Active Agents against Neurodegenerative Diseases (Alzheimer's Disease and Parkinson's Disease)", Journal of Drug Delivery, vol. 2011, Article ID 469679, 2011, 12 pages.
Tolentino, et al., "Intravitreal Injection of Vascular Endothelial Growth Factor Small Interfering RNA Inhibits Growth and Leakage in A Nonhuman Primate, Laser-Induced Model of Choroidal Neovascularization", Retina, vol. 24, No. 4, Aug. 2004, 132-138.
Topilina, et al., "Recent Advances in in Vivo Applications of Intein-Mediated Protein Splicing", Mobile DNA, vol. 5, No. 5, 2014, 1-14.

(56) References Cited

OTHER PUBLICATIONS

Van Embden, et al., "Genetic Variation and Evolutionary Origin of the Direct Repeat Locus of *Mycobacterium tuberculosis* Complex Bacteria", Journal of Bacteriology, vol. 182, No. 9, May 2000, 2393-2401.

Wahlgren, et al., "Plasma Exosomes can Deliver Exogenous Short Interfering RNA to Monocytes and Lymphocytes", Nucleic Acid Research, vol. 40, No. 17, e130, May 22, 2012, 12 pages.

Wang, et al., "A Phenotypic Screen for Functional Mutants of Human Adenosine Deaminase Acting on RNA 1", ACS Chemical Biology, vol. 10, No. 11, Nov. 20, 2015, 2512-2519.

Wang, et al., "One-Step Generation of Mice Carrying Mutations in Multiple Genes by CRISPR/Cas-Mediated Genome Engineering", Cell, vol. 153, No. 4, May 9, 2013, 910-918.

Weintraub, Karen, "The New Gold Standard", Nature, vol. 495, Mar. 14, 2013, S14-S16.

Wettengel, et al., "Harnessing Human ADAR2 for RNA Repair—Recoding a PINK1 Mutation Rescues Mitophagy", Nucleic Acids Research, vol. 45, No. 5, 2017, 2797-2808.

Wong, et al., "Substrate Recognition by ADAR1 and ADAR2", RNA, vol. 7, 2001, 846-858.

Woo, et al., "DNA-Free Genome Editing in Plants with Preassembled CRISPR-Cas9 Ribonucleoproteins", Nature Biotechnology, vol. 33, No. 11, Nov. 2015, 1162-1164.

Wroblewska, et al., "Mammalian Synthetic Circuits with RNA Binding Proteins for RNA-Only Delivery", Nature Biotechnology, vol. 33, No. 8, Aug. 2015, 839-841.

Xia, et al., "siRNA-Mediated Gene Silencing in Vitro and in Vivo", Nature Biotechnology, vol. 20, Issue 10, Sep. 2002, 1006-1010.

Xu, et al., "Sequence Determinants of Improved CRISPR SgRNA Design", Genome Research, vol. 25, No. 8, Aug. 2015, 1147-1157.

Yan, et al., "Cas13d Is a Compact RNA-Targeting Type VI CRISPR Effector Positively Modulated by a WYL-Domain-Containing Accessory Protein", Molecular Cell, vol. 70, No. 2, Apr. 19, 2018, 327-339.

Yin, et al., "A Geminivirus-Based Guide RNA Delivery System for CRISPR/Cas9 Mediated Plant Genome Editing", Scientific Reports, vol. 5, Article No. 14926, Oct. 9, 2015, 10 pages.

Young, et al., "Hollow Spherical Nucleic Acids for Intracellular Gene Regulation Based Upon Biocompatible Silica Shells", Nano Letters, vol. 12, Issue 7, Jul. 11, 2012, 3867-3871.

Younis, et al., "RNA Interference (RNAi) Induced Gene Silencing: A Promising Approach of Hi-Tech Plant Breeding", International Journal of Biological Sciences, vol. 10, No. 10, 2014, 1150-1158.

Zetsche, et al., "A Split-Cas9 Architecture for Inducible Genome Editing and Transcription Modulation", Nature Biotechnology, vol. 33, No. 2, Feb. 2015, 139-142.

Zetsche, et al., "Cpf1 is a Single RNA-Guided Endonuclease of a Class 2 CRISPR-Cas System", Cell, vol. 163, No. 3, Oct. 22, 2015, 759-771.

Zhang, et al., "A Strategy for Increasing Drug Solubility and Efficacy through Covalent Attachment to Polyvalent DNA-Nanoparticle Conjugates", ACS Nano, vol. 5, No. 9, Sep. 27, 2011, 6962-6970.

Zhang, et al., "Antibody-linked Spherical Nucleic Acids for Cellular Targeting", Journal of the American Chemical Society, vol. 134, Issue 40, Oct. 10, 2012, 16488-16491.

Zhang, et al., "Structure-Based Prediction of Protein-Protein Interactions on a Genome-Wide Scale", Nature, vol. 490, Oct. 25, 2012, 556-560.

Zheng, et al., "DNA Editing in DNA/RNA Hybrids by Adenosine Deaminases that Act on RNA", Nucleic Acids Research, vol. 45, No. 6, 2017, 3369-3377.

Gruber, et al. The Vienna RNA Websuite Nucleic Acids Research, vol. 36, 2008, W70-W74.

The Broad Institute, Inc., "Office Action for Canadian Patent Application No. 3,056,236", dated Oct. 6, 2020, 7 pages.

The Broad Institute, Inc., "Communication pursuant to Article 94(3) EPC for EP 18715416.6", dated Sep. 22, 2020, 6 pages.

The Broad Institute, Inc., Examination Report No. 2 for Standard Patent Application for Australian Patent Application No. 2018234825, dated Oct. 7, 2020, 2 pages.

Smargon, et al., "Cas13b Is a Type VI-B CRISPR-Associated RNA-Guided RNase Differentially Regulated by Accessory Proteins Csx27 and Csx28", Molecular Cell, vol. 65, No. 4, Feb. 16, 2017, 618-630.

Kim, et al., "Increasing the Genome-Targeting Scope and Precision of Base Editing with Engineered Cas9-Cytidine Deaminase Fusions", Nature Biotechnology, vol. 35, No. 4, 2017, 371-376.

Kim, et al., "RNA Interference: Applications and Advances in Insect Toxicology and Insect Pest Management", Pesticide Biochemistry and Physiology, vol. 120, 2015, 109-117.

Komor, et al., "CRISPR-Based Technologies for the Manipulation of Eukaryotic Genomes", Cell, vol. 168, No. (1-2), Jan. 12, 2017, 20-36.

Komor, et al., "Programmable Editing of a Target Base in Genomic DNA without Double-Stranded DNA Cleavage", Nature, vol. 533, No. 7603, May 19, 2016, 420-424.

Konermann, et al., "Genome-Scale Transcriptional Activation by an Engineered CRISPR-Cas9 Complex", Nature, vol. 517, Jan. 29, 2015, 583-588.

Konermann, et al., "Optical Control of Mammalian Endogenous Transcription and Epigenetic States", Nature, vol. 500, No. 7463, Aug. 22, 2013, 472-476.

Kormann, et al., "Expression of Therapeutic Proteins After Delivery of Chemically Modified mRNA in Mice", Nature Biotechnology, vol. 29, 2011, 154-157.

Kumar, et al., "Dicer 1 Functions as a Haploinsufficient Tumor Suppressor", Genes and Development, vol. 23, No. 23, Dec. 1, 2009, 2700-2704.

Kuttan, et al., "Mechanistic Insights into Editing-Site Specificity of ADARs", Proceedings of the National Academy of Sciences, USA, vol. 48, 2012, E3295-E3304.

Lanoiselee, et al., "APP, PSEN1, And PSEN2 Mutations in Early-Onset Alzheimer Disease: A Genetic Screening Study of Familial and Sporadic Cases", PLOS Medicine, vol. 14, No. 3, Mar. 28, 2017, 16 pages.

Lawrence, et al., "Supercharging Proteins Can Impart Unusual Resilience", Journal of the American Chemical Society, vol. 129, Issue 33, Aug. 1, 2007, 10110-10112.

Lee, et al., "Synthetically Modified Guide RNA and Donor DNA are a Versatile Platform for CRISPR-Cas9 Engineering", eLIFE, vol. 6, 2017, 23 pages.

Lehmann, et al., "Double-Stranded RNA Adenosine Deaminases ADAR1 and ADAR2 Have Overlapping Specificities", Biochemistry, vol. 39, No. 42, 2000, 12875-12884.

Lewis, et al., "Efficient Delivery of siRNA for Inhibition of Gene Expression in Postnatal Mice", Nature Genetics, vol. 32, Sep. 2002, 107-108.

Li, et al., "Carriers of Rare Missense Variants in IFIH1 are Protected from Psoriasis", Journal of Investigative Dermatology, vol. 130, No. 12, Dec. 2010, 2768-2772.

Li, et al., "Engineering CRISPR-Cpf1 Crrnas and Mrnas to Maximize Genome Editing Efficiency", Nature Biomedical Engineering, vol. 1, No. 5, May 2017, 21 pages.

Mackay, et al., "The Prospects for Designer Single-Stranded RNA-Binding Proteins", Nature Structural & Molecular Biology, vol. 18, No. 3, Mar. 2011, 256-261.

Mali, et al., "RNA-Guided Human Genome Engineering via Cas9", Science, vol. 339, No. 6121, Feb. 15, 2013, 823-826.

Matthews, MM., et al., "Structures of Human ADAR2 Bound to dsRNA Reveal Base-flipping Mechanism and Basis for Site Selectivity", Nature Structural & Molecular Biology, vol. 23, No. 5, May 2016, 426-433.

Mirkin, Chad, "Interview: An Interview with Chad Mirkin: Nanomedicine Expert", Nanomedicine, vol. 7, Issue 5, May 2012, 635-638.

Miyazaki, et al., "Destabilizing Domains Derived from the Human Estrogen Receptor", Journal of the American Chemical Society, vol. 134, No. 9, 2012, 3942-3945.

(56) References Cited

OTHER PUBLICATIONS

Mojica, et al., "Intervening Sequences of Regularly Spaced Prokaryotic Repeats Derive from Foreign Genetic Elements", Journal of Molecular Evolution, vol. 60, No. 2, Mar. 2005, 174-182.

Mojica, et al., "MicroCorrespondence: Biological significance of a family of regularly spaced repeats in the genomes of Archaea, Bacteria and mitochondria", Molecular Microbiology, vol. 36, No. 1, 2000, 244-246.

Montiel-Gonzalez, et al., "An Efficient System for Selectively Altering Genetic Information within mRNAs", Nucleic Acids Research, vol. 44, No. 21, 2016, 12 pages.

Montiel-Gonzalez, "Correction of Mutations within the Cystic Fibrosis Transmembrane Conductance Regulator by Site-Directed RNA Editing", Proceedings of the National Academy of Sciences, vol. 110, No. 45, Nov. 5, 2013, 18285-18290.

Morrissey, et al., "Potent and Persistent In vivo Anti-HBV Activity of Chemically Modified siRNAs", Nature Biotechnology, vol. 23, No. 8, 2005, 6 pages.

Nelles, et al., "Applications of Cas9 as an RNA-Programmed RNA-Binding Protein", Bioessays, vol. 37, 2015, 1-8.

Nishida, et al., "Targeted Nucleotide Editing Using Hybrid Prokaryotic and Vertebrate Adaptive Immune Systems", Science, vol. 353, No. 6305, 2016, 10 pages.

Nishikura, Kazuko, "Functions and Regulation of RNA Editing by ADAR Deaminases", Annual Review of Biochemistry, vol. 79, 2010, 321-349.

Novobrantseva, et al., "Systemic RNAi-mediated Gene Silencing in Nonhuman Primate and Rodent Myeloid Cells", Molecular Therapy—Nucleic Acids, 2012, 13 pages.

Peng, et al., "An Archaeal CRISPR Type III-B System Exhibiting Distinctive RNA Targeting Features and Mediating Dual RNA and DNA Interference", Nucleic Acids Research, vol. 43, No. 1, Jan. 2015, 406-417.

Platt, et al., "CRISPR-Cas9 Knockin Mice for Genome Editing and Cancer Modelling", Cell, vol. 159, No. 2, Oct. 9, 2014, 440-455.

Price, et al., "Cas9-Mediated Targeting of Viral RNA in Eukaryotic Cells", Proceedings of the National Academy of Sciences, vol. 112, No. 19, May 12, 2015, 6164-6169.

Rahdar, et al., "Synthetic CRISPR RNA-Cas9-guided Genome Editing in Human Cells", Proceedings of the National Academy of Sciences, vol. 112, No. 51, Dec. 22, 2015, E7110-E7117.

Ramakrishna, et al., "Gene Disruption by Cell-Penetrating Peptide-Mediated Delivery of Cas9 Protein and Guide RNA", Genome Research, vol. 24, No. 6, Jun. 2014, 1020-1027.

Reich, et al., "Small Interfering RNA (siRNA) Targeting VEGF Effectively Inhibits Ocular Neovascularization in a Mouse Model", Molecular Vision, vol. 9, 2003, 210-216.

Rodriguez, et al., "Targeted Chemical-Genetic Regulation of Protein Stability In Vivo", Chemistry & Biology, vol. 19, No. 3, Mar. 23, 2012, 391-398.

Samai, et al., "Co-transcriptional DNA and RNA Cleavage during Type III CRISPR-Cas Immunity", Cell, vol. 161, No. 5, May 21, 2015, 1164-1174.

Schiffelers, et al., "Cancer siRNA Therapy by Tumor Selective Delivery with Ligand-Targeted Sterically Stabilized Nanoparticle", Nucleic Acids Research, vol. 32, No. 19, e149, 2004, 10 pages.

Schroeder, et al., "Lipid-Based Nanotherapeutics for siRNA Delivery", Journal of Internal Medicine, vol. 267, No. 1, Jan. 2010, 9-21.

Shalem, et al., "Genome-Scale CRISPR-Cas9 Knockout Screening in Human Cells", Science, vol. 343, No. 6166, Jan. 3, 2014, 84-87.

Shalem, et al., "High-Throughput Functional Genomics Using CRISPR-Cas9", Nature Reviews Genetics, vol. 16, No. 5, May 2015, 299-311.

Sharma, et al., "Antisense Oligonucleotides: Modifications and Clinical Trials", MedChemComm, vol. 5, 2014, 1454-1471.

Sharma, et al., "RNA Interference: A Novel Tool for Plant Disease Management", African Journal of Biotechnology, Academic Journals, vol. 12, No. 18, May 1, 2013, 2303-2312.

Shen, et al., "Gene Silencing by Adenovirus-Delivered siRNA", FEBS Letters, vol. 539, Mar. 2003, 111-114.

Shmakov, et al., "Discovery and Functional Characterization of Diverse Class 2 CRISPR-Cas Systems", Molecular Cell, vol. 60, No. 3, Nov. 5, 2015, 385-397.

Shmakov, S., et al., "Diversity and Evolution of Class 2 CRISPR-Cas Systems", Nature Reviews Microbiology, vol. 15, No. 3, Mar. 2017, 169-182.

Simeoni, et al., "Insight into the Mechanism of the Peptide-Based Gene Delivery System MPG: Implications for Delivery of siRNA into Mammalian Cells", Nucleic Acids Research, vol. 31, No. 11, 2003, 2717-2724.

Smith, et al., "A Directed Approach for Engineering Conditional Protein Stability Using Biologically Silent Small Molecules", The Journal Of Biological Chemistry, vol. 282, No. 34, Aug. 24, 2007, 24866-24872.

The Broad Institute, Inc., "Notice of Grounds for Rejection for Korean Patent Application No. 10-2019-7030158", dated Dec. 31, 2019, 14 pages.

Abil, et al., "Engineering Reprogrammable RNA-Binding Proteins for Study and Manipulation of the Transcriptome", Molecular BioSystems, The Royal Society of Chemistry, vol. 11, No. 10, 2015, 8 pages.

Abudayyeh, et al., "C2c2 is a Single-Component Programmable RNA-Guided RNA-Targeting CRISPR Effector", Science, vol. 353, No. 6299, Aug. 5, 2016, 11 pages.

Abudayyeh, et al., "RNA Targeting with CRISPR-Cas13a", Nature, vol. 550, No. 7675, Oct. 4, 2017, 280-284.

Akinc, et al., "A Combinatorial Library of Lipid-like Materials for Delivery of RNAi Therapeutics", Nature Biotechnology, vol. 26, Issue 5, May 2008, 561-569.

Alhasan, et al., "Exosome Encased Spherical Nucleic Acid Gold Nanoparticle Conjugates As Potent MicroRNA Regulation Agents", Small, vol. 10, Issue 1, Jan. 15, 2014, 186-192.

Allerson, et al., "Fully 2'-Modified Oligonucleotide Duplexes with Improved in Vitro Potency and Stability Compared to Unmodified Small Interfering RNA", Journal of Medicinal Chemistry, vol. 48, No. 4, 2005, 901-904.

Alvarez-Erviti, et al., "Delivery of siRNA to the Mouse Brain by Systemic Injection of Targeted Exosomes", Nature Biotechnology, vol. 29, No. 4, Apr. 2011, 341-345.

Ballatore, et al., "Tau-Mediated Neurodegeneration in Alzheimer's Disease and Related Disorders", Nature Reviews Neuroscience, vol. 8, No. 9, Sep. 2007, 663-672.

Banaszynski, et al., "A Rapid, Reversible, and Tunable Method to Regulate Protein Function in Living Cells Using Synthetic Small Molecules", Cell, vol. 126, No. 5, Sep. 8, 2006, 995-1004.

Banaszynski, et al., "Chemical Control of Protein Stability and Function in Living Mice", Nature Medicine, vol. 14, No. 10, Oct. 2008, 1123-1127.

Bartlett, et al., "Impact of Tumor-Specific Targeting on The Biodistribution and Efficacy of Sirna Nanoparticles Measured by Multimodality In Vivo Imaging", Proceedings of the National Academy of Sciences, vol. 104, No. 39, Sep. 25, 2007, 15549-15554.

Basha, Genc, et al., "Influence of Cationic Lipid Composition on Gene Silencing Properties of Lipid Nanoparticle Formulations of siRNA in Antigen-Presenting Cells", Molecular Therapy, vol. 19, No. 12, Dec. 2011, 2186-2200.

Bass, et al., "An Unwinding Activity that Covalently Modifies its Double-Stranded RNA Substrate", Cell, vol. 55, No. 6, Dec. 23, 1988, 1089-1098.

Bocobza, et al., "Small Molecules that Interact with RNA: Riboswitch-Based Gene Control and its Involvement in Metabolic Regulation in Plants and Algae", The Plant Journal, vol. 79, No. 4, 2014, 693-703.

Bramsen, et al., "Development of Therapeutic-Grade Small Interfering RNAs by Chemical Engineering", Frontiers in Genetics, vol. 3, Article 154, Aug. 2012, 22 pages.

Carr, et al., "Genome Engineering", Nature Biotechnology, vol. 27, No. 12, Dec. 2009, 1151-1162.

Chen, et al., "An Efficient Antiviral Strategy for Targeting Hepatitis B Virus Genome Using Transcription Activator-Like Effector Nucleases", Molecular Therapy, vol. 22, Issue 2, Feb. 2014, 303-311.

(56) References Cited

OTHER PUBLICATIONS

Chen, et al., "Genome-Wide CRISPR Screen in a Mouse Model of Tumor Growth and Metastasis", Cell, vol. 160, No. 6, Mar. 12, 2015, 1246-1260.

Chen, et al., "Predicting Peptide-Mediated Interactions on a Genome-Wide Scale", PLOS Computational Biology, vol. 11, No. 5, May 4, 2015, 13 pages.

Chen, et al., "RNA Imaging. Spatially Resolved, Highly Multiplexed RNA Profiling in Single Cells", Science, vol. 348, No. 6233, Apr. 24, 2015, aaa6090-1-aaa6090-14.

Cho, et al., "Lipid-like Nanoparticles for Small Interfering RNA Delivery to Endothelial Cells", Advanced Functional Materials, vol. 19, Issue 19, Oct. 9, 2009, 3112-3118.

Choi, et al., "Mechanism for the Endocytosis of Spherical Nucleic Acid Nanoparticle Conjugates", Proceedings of the National Academy of Sciences, vol. 110, No. 19, 2013, 7625-7630.

Cong, et al., "Multiplex Genome Engineering Using CRISPR/Cas Systems", Science, vol. 339, No. 6121, 2013, 819-823.

Cutler, et al., "Polyvalent Nucleic Acid Nanostructures", Journal of the American Chemical Society, vol. 133, Issue 24, Jun. 22, 2011, 9254-9257.

Cutler, et al., "Spherical Nucleic Acids", Journal of the American Chemical Society, vol. 134, Issue 3, 2012, 1376-1391.

Dahlman, et al., "In Vivo Endothelial siRNA Delivery Using Polymeric Nanoparticles wiht Low Molecular Weight", Nature Nanotechnology, vol. 9, No. 8, Aug. 2014, 648-655.

Dahlman, et al., "Orthogonal Gene Knock Out and Activation with a Catalytically Active Cas9 Nuclease", Nature Biotechnology, vol. 33, No. 11, Nov. 2015, 1159-1161.

Davis, et al., "Evidence of RNAi in Humans From Systemically Administered siRNA via Targeted Nanoparticles", Nature, vol. 464, No. 7291, Apr. 15, 2010, 1067-1070.

Deng, et al., "CASFISH: CRISPR/Cas9-mediated in situ labeling of genomic loci in fixed cells", Proceedings of the National Academy of Sciences, vol. 112, No. 38, 2015, 11870-11875.

Dey, et al., "Toward a "Structural BLAST": Using Structural Relationships to Infer Function", Protein Science, vol. 22, No. 4, Apr. 2013, 359-366.

Digiusto, et al., "RNA-Based Gene Therapy for HIV with Lentiviral Vector-Modified CD34(+) Cells in Patients Undergoing Transplantation for AIDSrelated Lymphoma", Science Translational Medicine, vol. 2, Issue 36, Jun. 16, 2010, 8 pages.

El-Andaloussi, et al., "Exosome-Mediated Delivery of siRNA in Vitro and in Vivo", Nature Protocols, vol. 7, Issue 12, Dec. 2012, 2112-2126.

Finkel, et al., "Treatment of Infantile-Onset Spinal Muscular Atrophy with Nusinersen: A Phase 2, Open-Label, Dose-Escalation Study", The Lancet, vol. 388, Issue 10063, Dec. 2016, 3017-3026.

Fukuda, et al., "Construction of a Guide-RNA for Site-Directed RNA Mutagenesis Utilising Intracellular A-To-I RNA Editing", Scientific Reports, vol. 7, No. 41478, Feb. 2017, 13 pages.

Gao, et al., "A De Novo Loss-Of-Function GRIN2A Mutation Associated with Childhood Focal Epilepsy and Acquired Epileptic Aphasia", PLOS One, vol. 12, No. 12, Feb. 9, 2017, 20 pages.

Geary, et al., "A Single-Stranded Architecture for Cotranscriptional Folding of RNA Nanostructures", Science, vol. 345, No. 6198, Aug. 15, 2014, 799-804.

Goldfless, et al., "Direct and Specific Chemical Control of Eukaryotic Translation with a Synthetic RNA-Protein Interaction", Nucleic Acids Research, vol. 40, No. 9, e64, 2012, 1-12.

Gootenberg, et al., "Nucleic Acid Detection with CRISPR-Cas13a/C2c2", Science, vol. 356, No. 6336, Apr. 13, 2017, 438-442.

Green, Jerry M.., "Current State of Herbicides in Herbicide-Resistant Crops", Society of Chemical Industry, Pest Management Science, vol. 70, No. 9, 2014, 7 pages.

Grimm, et al., "In Vitro and In Vivo Gene Therapy Vector Evolution via Multispecies Interbreeding and Retargeting of Adeno-Associated Viruses", Journal of Virology, vol. 82, No. 12, Jun. 2008, 5887-5911.

Hale, et al., "RNA-Guided RNA Cleavage by a CRISPR RNA-Cas Protein Complex", Cell, vol. 139, No. 5, Nov. 25, 2009, 945-956.

Hale, et al., "Target RNA Capture and Cleavage by the Cmr Type III-B CRISPR-Cas Effector Complex", Genes & Development, vol. 28, No. 21, Sep. 29, 2014, 2432-2443.

Hao, et al., "Nucleic Acid—Gold Nanoparticle Conjugates as Mimics of microRNA", Small, vol. 7, Issue 22, Nov. 18, 2011, 3158-3162.

Hendel, et al., "Chemically Modified Guide RNAs Enhance CRISPR-Cas Genome Editing in Human Primary Cells", Nature Biotechnology, vol. 33, No. 9, Sep. 2015, 985-989.

Hsu, et al., "Development and Applications of CRISPR-Cas9 for Genome Engineering", Cell, vol. 157, No. 6, Jun. 5, 2014, 1262-1278.

Jansen, et al., "Identification of a Novel Family of Sequence Repeats among Prokaryotes", OMICS: A Journal of Integrative Biology, vol. 6, No. 1, Feb. 2002?, 23-33.

Jansen, et al., "Identification of Genes that are Associated with DNA Repeats in Prokaryotes", Molecular Microbiology, vol. 43, Issue 6, Apr. 25, 2002, 1565-1575.

Jensen, et al., "Spherical Nucleic Acid Nanoparticle Conjugates as an RNAi-Based Therapy for Glioblastoma", Science Translational Medicine, vol. 5, Issue 209, Oct. 30, 2013, 12 pages.

Kelley, M., et al., "Versatility of chemically synthesized guide RNAs for CRISPR-Cas9 genome editing", Journal of Biotechnology, vol. 233, Jun. 2016, 74-83.

Kim, et al., "A Guide to Genome Engineering with Programmable Nucleases", Nature Reviews Genetics, vol. 15, May 2014, 321-334.

The Broad Institute, Inc., "Office Action for Canadian Patent Application No. 3,056,236", dated Sep. 17, 2021, 6 pages.

The Broad Institute, Inc., "Communication pursuant to Article 94(3) EPC for European Patent Application No. 18715416.6", dated Oct. 4, 2021, 4 pages.

The Broad Institute, Inc., "Notice of Grounds for Rejection for Korean Patent Application No. 10-2020-7034051", dated Dec. 28, 2021 6 pages.

The Broad Institute, Inc., "Notice of Reasons for Rejection for Japanese Patent Application No. 2019-551295", dated Apr. 5, 2022, 12 pages.

The Broad Institute, Inc., "Examination Report No. 1 for Standard Patent Application for Australian Patent Application No. 2021201683", dated Oct. 27, 2022, 7 pages.

The Broad Institute, Inc., "Communication Pursuant to Article 94(3) EPC for European Patent Application No. 18715416.6", dated Aug. 29, 2022, 4 pages.

* cited by examiner

Ortholog 3 (PB)

Ortholog 3+csx28

Ortholog 5

Ortholog 6

Ortholog 6

Derived PFS
TG — NAG

Ortholog 7

Derived PFS
AT

Ortholog 8

Ortholog 8 +csx28

Ortholog 9

Ortholog 9 +csx28

Ortholog 10

Derived PFS
AG

Ortholog 12

Derived PFS
AG

Ortholog 13

Ortholog 13 +csx27

Ortholog 14

Ortholog 14 + csx28

Ortholog 16 +csx27

Derived PFS
TA

Ortholog 17

Derived PFS
T — NAA

Ortholog 19

Derived PFS
A — NAA

Ortholog 19 +csx28

Ortholog 21

Ortholog 21 + csx28

Ortholog 5

Ortholog 7

Ortholog 8

Ortholog 14

Ortholog 15

Ortholog 19

SEQ ID NO: 524

SEQ ID NO: 525

D.

E.

F.

CAS13B ORTHOLOGUES CRISPR ENZYMES AND SYSTEMS

RELATED APPLICATIONS AND INCORPORATION BY REFERENCE

This application is a National Stage application of International Application No. PCT/US2018/022751, filed Mar. 15, 2018 which claims the benefit of to U.S. provisional application 62/471,710, filed Mar. 15, 2017 and U.S. provisional application 62/566,829, filed Oct. 2, 2017.

Reference is made to PCT application including as it designates the US, inter alia, application No. PCT/US2016/058302, filed Oct. 21, 2016. Reference is made to U.S. provisional patent application 62/245,270 filed on Oct. 22, 2015, U.S. provisional patent application 62/296,548 filed on Feb. 17, 2016, and U.S. provisional patent applications 62/376,367 and 62/376,382, filed on Aug. 17, 2016. Reference is further made to U.S. provisional 62/471,792, filed Mar. 15, 2017 and U.S. provisional 62/484,786, filed Apr. 12, 2017. Mention is made of: Smargon et al. (2017), "Cas13b Is a Type VI-B CRISPR-Associated RNA-Guided RNase Differentially Regulated by Accessory Proteins Csx27 and Csx28," Molecular Cell 65, 618-630 (Feb. 16, 2017) doi: 10.1016/j.molcel.2016.12.023. Epub Jan. 5, 2017 and Smargon et al. (2017), "Cas13b Is a Type VI-B CRISPR-Associated RNA-Guided RNase Differentially Regulated by Accessory Proteins Csx27 and Csx28," bioRxiv 092577; doi: https://doi.org/10.1101/092577. Posted Dec. 9, 2017. Each of the foregoing applications and literature citations are hereby incorporated herein by reference.

STATEMENT AS TO FEDERALLY SPONSORED RESEARCH

This invention was made with government support under grant numbers MH100706 and MH110049 awarded by the National Institutes of Health. The government has certain rights in the invention.

SEQUENCE LISTING

This application contains a sequence listing filed in electronic form as an ASCII.txt file entitled BROD-2780US_ST25.txt, created on Jul. 22, 2021, and having a size of 1,279,801 bytes, the content of which is incorporated herein in its entirety.

Indeed, all documents cited or referenced herein and in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FIELD OF THE INVENTION

The present invention generally relates to systems, methods and compositions used for the control of gene expression involving sequence targeting, such as perturbation of gene transcripts or nucleic acid editing, that may use vector systems related to Clustered Regularly Interspaced Short Palindromic Repeats (CRISPR) and components thereof.

BACKGROUND OF THE INVENTION

The CRISPR-CRISPR associated (Cas) systems of bacterial and archaeal adaptive immunity are some such systems that show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important. Novel Cas13b orthologues and uses thereof are desirable.

Citation or identification of any document in this application is not an admission that such document is available as prior art to the present invention.

SUMMARY OF THE INVENTION

Effector proteins include two subgroups, Type VI-B1 and Type VI-B2, and include members which are RNA-programmable nucleases, RNA-interfering and may be involved in bacterial adoptive immunity against RNA phages. A Cas13b system can comprise a large single effector (approximately 1100 amino acids in length), and one or none of two small putative accessory proteins (approximately 200 amino acids in length) nearby a CRISPR array. Based on the nearby small protein, the system is bifurcated into two Loci A and B. No additional proteins out to 25 kilobase pairs upstream or downstream from the array are conserved across species with each locus. With minor exceptions, the CRISPR array comprises direct repeat sequences 36 nucleotides in length and spacer sequences 30 nucleotides in length. The direct repeat is generally well conserved, especially at the ends, with a GTTG/GUUG at the 5' end reverse complementary to a CAAC at the 3' end. This conservation suggests strong base pairing for an RNA loop structure that potentially interacts with the protein(s) in the locus. A motif search complementary to the direct repeats revealed no candidate tracrRNAs nearby the arrays, possibly indicative of a single crRNA like that found in the Cpf1 locus.

In embodiments of the invention, a Type VI-B system comprises a novel Cas13b effector protein and optionally a small accessory protein encoded upstream or downstream of the Cas13b effector protein. In certain embodiments, the small accessory protein enhances the Cas13b effector's ability to target RNA.

The invention provides a non-naturally occurring or engineered composition comprising
i) a certain novel Cas13b effector protein, and
ii) a crRNA,
wherein the crRNA comprises a) a guide sequence that is capable of hybridizing to a target RNA sequence, and b) a direct repeat sequence, whereby there is formed a CRISPR complex comprising the Cas13b effector protein complexed with the guide sequence that is hybridized to the target RNA sequence. The complex can be formed in vitro or ex vivo and introduced into a cell or contacted with RNA; or can be formed in vivo.

In some embodiments, a non-naturally occurring or engineered composition of the invention may comprise an accessory protein that enhances Type VI-B CRISPR-Cas effector protein activity.

In certain such embodiments, the accessory protein that enhances Cas13b effector protein activity is a csx28 protein. In such embodiments, the Type VI-B CRISPR-Cas effector protein and the Type VI-B CRISPR-Cas accessory protein may be from the same source or from a different source.

In some embodiments, a non-naturally occurring or engineered composition of the invention comprises an accessory protein that represses Cas13b effector protein activity.

In certain such embodiments, the accessory protein that represses Cas13b effector protein activity is a csx27 protein. In such embodiments, the Type VI-B CRISPR-Cas effector protein and the Type VI-B CRISPR-Cas accessory protein may be from the same source or from a different source. In certain embodiments of the invention, the Type VI-B CRISPR-Cas effector protein is from Table 1A or 1B. In certain embodiments, the Type VI-B CRISPR-Cas accessory protein is from Table 1A or Table 1B.

In some embodiments, a non-naturally occurring or engineered composition of the invention comprises two or more crRNAs.

In some embodiments, a non-naturally occurring or engineered composition of the invention comprises a guide sequence that hybridizes to a target RNA sequence in a prokaryotic cell.

In some embodiments, a non-naturally occurring or engineered composition of the invention comprises a guide sequence that hybridizes to a target RNA sequence in a eukaryotic cell.

In some embodiment, the Cas13b effector protein comprises one or more nuclear localization signals (NLSs).

The Cas13b effector protein of the invention is, or in, or comprises, or consists essentially of, or consists of, or involves or relates to such a protein from or as set forth in Table 1A or Table 1B. This invention is intended to provide, or relate to, or involve, or comprise, or consist essentially of, or consist of, a protein from or as set forth in Table 1A or Table 1B, including mutations or alterations thereof as set forth herein. A Table 1A or Table 1B Cas13b effector protein is discussed herein in more detail in conjunction with Table 1A or Table 1B.

In some embodiment of the non-naturally occurring or engineered composition of the invention, the Cas13b effector protein is associated with one or more functional domains. The association can be by direct linkage of the effector protein to the functional domain, or by association with the crRNA. In a non-limiting example, the crRNA comprises an added or inserted sequence that can be associated with a functional domain of interest, including, for example, an aptamer or a nucleotide that binds to a nucleic acid binding adapter protein.

In certain non-limiting embodiments, a non-naturally occurring or engineered composition of the invention comprises a functional domain cleaves the target RNA sequence.

In certain non-limiting embodiments, the non-naturally occurring or engineered composition of the invention comprises a functional domain that modifies transcription or translation of the target RNA sequence.

In some embodiment of the composition of the invention, the Cas13b effector protein is associated with one or more functional domains; and the effector protein contains one or more mutations within an HEPN domain, whereby the complex can deliver an epigenentic modifier or a transcriptional or translational activation or repression signal. The complex can be formed in vitro or ex vivo and introduced into a cell or contacted with RNA; or can be formed in vivo.

In some embodiment of the non-naturally occurring or engineered composition of the invention, the Cas13b effector protein and the accessory protein are from the same organism.

In some embodiment of the non-naturally occurring or engineered composition of the invention, the Cas13b effector protein and the accessory protein are from different organisms.

The invention also provides a Type VI-B CRISPR-Cas vector system, which comprises one or more vectors comprising:

a first regulatory element operably linked to a nucleotide sequence encoding the Cas13b effector protein, and a second regulatory element operably linked to a nucleotide sequence encoding the crRNA.

In certain embodiments, the vector system of the invention further comprises a regulatory element operably linked to a nucleotide sequence of a Type VI-B CRISPR-Cas accessory protein.

When appropriate, the nucleotide sequence encoding the Type VI-B CRISPR-Cas effector protein and/or the nucleotide sequence encoding the Type VI-B CRISPR-Cas accessory protein is codon optimized for expression in a eukaryotic cell.

In some embodiment of the vector system of the invention, the nucleotide sequences encoding the Cas13b effector protein and the accessory protein are codon optimized for expression in a eukaryotic cell.

In some embodiment, the vector system of the invention comprises in a single vector.

In some embodiment of the vector system of the invention, the one or more vectors comprise viral vectors.

In some embodiment of the vector system of the invention, the one or more vectors comprise one or more retroviral, lentiviral, adenoviral, adeno-associated or herpes simplex viral vectors.

The invention provides a delivery system configured to deliver a Cas13b effector protein and one or more nucleic acid components of a non-naturally occurring or engineered composition comprising i) a Cas13b effector protein, and ii) a crRNA, wherein the crRNA comprises a) a guide sequence that hybridizes to a target RNA sequence in a cell, and b) a direct repeat sequence, wherein the Cas13b effector protein forms a complex with the crRNA, wherein the guide sequence directs sequence-specific binding to the target RNA sequence, whereby there is formed a CRISPR complex comprising the Cas13b effector protein complexed with the guide sequence that is hybridized to the target RNA sequence. The complex can be formed in vitro or ex vivo and introduced into a cell or contacted with RNA; or can be formed in vivo.

In some embodiment of the delivery system of the invention, the system comprises one or more vectors or one or more polynucleotide molecules, the one or more vectors or polynucleotide molecules comprising one or more polynucleotide molecules encoding the Cas13b effector protein and one or more nucleic acid components of the non-naturally occurring or engineered composition.

In some embodiment, the delivery system of the invention comprises a delivery vehicle comprising liposome(s), particle(s), exosome(s), microvesicle(s), a gene-gun or one or more viral vector(s).

In some embodiment, the non-naturally occurring or engineered composition of the invention is for use in a therapeutic method of treatment or in a research program.

In some embodiment, the non-naturally occurring or engineered vector system of the invention is for use in a therapeutic method of treatment or in a research program.

In some embodiment, the non-naturally occurring or engineered delivery system of the invention is for use in a therapeutic method of treatment or in a research program.

The invention provides a method of modifying expression of a target gene of interest, the method comprising contacting a target RNA with one or more non-naturally occurring or engineered compositions comprising i) a Cas13b effector protein, and ii) a crRNA, wherein the crRNA comprises a) a guide sequence that hybridizes to a target RNA sequence in a cell, and b) a direct repeat sequence, wherein the Cas13b effector protein forms a complex with the crRNA, wherein the guide sequence directs sequence-specific binding to the target RNA sequence in a cell, whereby there is formed a CRISPR complex comprising the Cas13b effector protein complexed with the guide sequence that is hybridized to the target RNA sequence, whereby expression of the target locus of interest is modified. The complex can be formed in vitro or ex vivo and introduced into a cell or contacted with RNA; or can be formed in vivo.

In some embodiment, the method of modifying expression of a target gene of interest further comprises contacting the target RNA with an accessory protein that enhances Cas13b effector protein activity.

In some embodiment of the method of modifying expression of a target gene of interest, the accessory protein that enhances Cas13b effector protein activity is a csx28 protein.

In some embodiment, the method of modifying expression of a target gene of interest further comprises contacting the target RNA with an accessory protein that represses Cas13b effector protein activity.

In some embodiment of the method of modifying expression of a target gene of interest, the accessory protein that represses Cas13b effector protein activity is a csx27 protein.

In some embodiment, the method of modifying expression of a target gene of interest comprises cleaving the target RNA.

In some embodiment, the method of modifying expression of a target gene of interest comprises increasing or decreasing expression of the target RNA.

In some embodiment of the method of modifying expression of a target gene of interest, the target gene is in a prokaryotic cell.

In some embodiment of the method of modifying expression of a target gene of interest, the target gene is in a eukaryotic cell.

The invention provides a cell comprising a modified target of interest, wherein the target of interest has been modified according to any of the method disclosed herein.

In some embodiment of the invention, the cell is a prokaryotic cell.

In some embodiment of the invention, the cell is a eukaryotic cell.

In some embodiment, modification of the target of interest in a cell results in:

a cell comprising altered expression of at least one gene product;

a cell comprising altered expression of at least one gene product, wherein the expression of the at least one gene product is increased; or a cell comprising altered expression of at least one gene product, wherein the expression of the at least one gene product is decreased.

In some embodiment, the cell is a mammalian cell or a human cell.

The invention provides a cell line of or comprising a cell disclosed herein or a cell modified by any of the methods disclosed herein, or progeny thereof.

The invention provides a multicellular organism comprising one or more cells disclosed herein or one or more cells modified according to any of the methods disclosed herein.

The invention provides a plant or animal model comprising one or more cells disclosed herein or one or more cells modified according to any of the methods disclosed herein.

The invention provides a gene product from a cell or the cell line or the organism or the plant or animal model disclosed herein.

In some embodiment, the amount of gene product expressed is greater than or less than the amount of gene product from a cell that does not have altered expression.

The invention provides an isolated Cas13b effector protein, comprising or consisting essentially of or consisting of or as set forth in Table 1A or Table 1B. A Table 1A or Table 1B Cas13b effector protein is as discussed in more detail herein in conjunction with Table 1A or Table 1B. The invention provides an isolated nucleic acid encoding the Cas13b effector protein. In some embodiments of the invention the isolated nucleic acid comprises DNA sequence and further comprises a sequence encoding a crRNA. The invention provides an isolated eukaryotic cell comprising the nucleic acid encoding the Cas13b effector protein. Thus, herein, "Cas13b effector protein" or "effector protein" or "Cas" or "Cas protein" or "RNA targeting effector protein" or "RNA targeting protein" or like expressions is to be understood with reference to Table 1A or Table 1B and can be read as a Table 1A or Table 1B Cas13b effector protein; expressions such as "RNA targeting CRISPR system" are to be understood with reference to Table 1A or Table 1B and can be read as a Table 1A or Table 1B Cas13b effector protein CRISPR system; and references to guide RNA or sgRNA are to be read in conjunction with the herein-discussion of the Cas13b system crRNA, e.g., that which is sgRNA in other systems may be considered as or akin to crRNA in the instant invention.

The invention provides a method of identifying the requirements of a suitable guide sequence for the Cas13b effector protein of the invention (e.g., Table 1A or Table 1B), said method comprising:

(a) selecting a set of essential genes within an organism (b) designing a library of targeting guide sequences capable of hybridizing to regions the coding regions of these genes as well as 5' and 3' UTRs of these genes (c) generating randomized guide sequences that do not hybridize to any region within the genome of said organism as control guides (d) preparing a plasmid comprising the RNA-targeting protein and a first resistance gene and a guide plasmid library comprising said library of targeting guides and said control guides and a second resistance gene, (e) co-introducing said plasmids into a host cell (f) introducing said host cells on a selective medium for said first and second resistance genes (g) sequencing essential genes of growing host cells (h) determining significance of depletion of cells transformed with targeting guides by comparing depletion of cells with control guides; and (i) determining based on the depleted guide sequences the requirements of a suitable guide sequence.

In one aspect of such method, determining the PFS sequence for suitable guide sequence of the RNA-targeting protein is by comparison of sequences targeted by guides in depleted cells. In one aspect of such method, the method further comprises comparing the guide abundance for the different conditions in different replicate experiments. In one aspect of such method, the control guides are selected in that they are determined to show limited deviation in guide depletion in replicate experiments. In one aspect of such method, the significance of depletion is determined as (a) a depletion which is more than the most depleted control guide; or (b) a depletion which is more than the average depletion plus two times the standard deviation for the control guides. In one aspect of such method, the host cell is a bacterial host cell. In one aspect of such method, the step of co-introducing the plasmids is by electroporation and the host cell is an electro-competent host cell.

Cas13b

The invention provides a method of modifying sequences associated with or at a target locus of interest, the method comprising delivering to said locus a non-naturally occurring or engineered composition comprising a Cas13b effector protein and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA or consists of RNA.

The invention provides a method of modifying sequences associated with or at a target locus of interest, the method comprising delivering to said locus a non-naturally occurring or engineered composition comprising a Cas13b effector protein, optionally a small accessory protein, and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA or consists of RNA.

The invention provides a method of modifying sequences associated with or at a target locus of interest, the method comprising delivering to said sequences associated with or at the locus a non-naturally occurring or engineered composition comprising a Cas13b loci effector protein and one or more nucleic acid components, wherein the Cas13b effector protein forms a complex with the one or more nucleic acid components and upon binding of the said complex to the locus of interest the effector protein induces the modification of sequences associated with or at the target locus of interest. In a preferred embodiment, the modification is the introduction of a strand break. In a preferred embodiment the Cas13b effector protein forms a complex with one nucleic acid component; advantageously an engineered or non-naturally occurring nucleic acid component. The induction of modification of sequences associated with or at the target locus of interest can be Cas13b effector protein-nucleic acid guided. In a preferred embodiment the one nucleic acid component is a CRISPR RNA (crRNA). In a preferred embodiment the one nucleic acid component is a mature crRNA or guide RNA, wherein the mature crRNA or guide RNA comprises a spacer sequence (or guide sequence) and a direct repeat (DR) sequence or derivatives thereof. In a preferred embodiment the spacer sequence or the derivative thereof comprises a seed sequence, wherein the seed sequence is critical for recognition and/or hybridization to the sequence at the target locus. In a preferred embodiment of the invention the crRNA is a short crRNA that may be associated with a short DR sequence. In another embodiment of the invention the crRNA is a long crRNA that may be associated with a long DR sequence (or dual DR). Aspects of the invention relate to Cas13b effector protein complexes having one or more non-naturally occurring or engineered or modified or optimized nucleic acid components. In a preferred embodiment the nucleic acid component comprises RNA. In a preferred embodiment the nucleic acid component of the complex may comprise a guide sequence linked to a direct repeat sequence, wherein the direct repeat sequence comprises one or more stem loops or optimized secondary structures. In preferred embodiments of the invention, the direct repeat may be a short DR or a long DR (dual DR). In a preferred embodiment the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

The invention provides methods of genome editing or modifying sequences associated with or at a target locus of interest wherein the method comprises introducing a Cas13b complex into any desired cell type, prokaryotic or eukaryotic cell, whereby the Cas13b effector protein complex effectively functions to interfere with RNA in the eukaryotic or prokaryotic cell. In preferred embodiments, the cell is a eukaryotic cell and the RNA is transcribed from a mammalian genome or is present in a mammalian cell. In preferred methods of RNA editing or genome editing in human cells, the Cas13b effector proteins may include but are not limited to the specific species of Cas13b effector proteins disclosed herein.

The invention also provides a method of modifying a target locus of interest, the method comprising delivering to said locus a non-naturally occurring or engineered composition comprising a Cas13b effector protein and one or more nucleic acid components, wherein the Cas13b effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within a RNA molecule. In such methods the target locus of interest may be comprised in a RNA molecule in vitro.

In such methods the target locus of interest may be comprised in a RNA molecule within a cell. The cell may be a prokaryotic cell or a eukaryotic cell. The cell may be a mammalian cell. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The mammalian cell many be a non-human mammal, e.g., primate, bovine, ovine, porcine, canine, rodent, Leporidae such as monkey, cow, sheep, pig, dog, rabbit, rat or mouse cell. The cell may be a non-mammalian eukaryotic cell such as poultry bird (e.g., chicken), vertebrate fish (e.g., salmon) or shellfish (e.g., oyster, claim, lobster, shrimp) cell. The cell may also be a plant cell. The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc).

The invention provides a method of modifying a target locus of interest, the method comprising delivering to said locus a non-naturally occurring or engineered composition comprising a Cas13b effector protein and one or more nucleic acid components, wherein the effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within an RNA molecule. In a preferred embodiment, the target locus of interest comprises or consists of RNA.

The invention also provides a method of modifying a target locus of interest, the method comprising delivering to said locus a non-naturally occurring or engineered composition comprising a Cas13b effector protein and one or more nucleic acid components, wherein the Cas13b effector protein forms a complex with the one or more nucleic acid components and upon binding of the said complex to the locus of interest the effector protein induces the modification of the target locus of interest. In a preferred embodiment, the modification is the introduction of a strand break.

Preferably, in such methods the target locus of interest may be comprised in a RNA molecule in vitro. Also preferably, in such methods the target locus of interest may be comprised in a RNA molecule within a cell. The cell may be a prokaryotic cell or a eukaryotic cell. The cell may be a mammalian cell. The cell may be a rodent cell. The cell may be a mouse cell.

In any of the described methods the target locus of interest may be a genomic or epigenomic locus of interest. In any of the described methods the complex may be delivered with multiple guides for multiplexed use. In any of the described methods more than one protein(s) may be used.

In further aspects of the invention the nucleic acid components may comprise a CRISPR RNA (crRNA) sequence. As the effector protein is a Cas13b effector protein, the nucleic acid components may comprise a CRISPR RNA (crRNA) sequence and generally may not comprise any trans-activating crRNA (tracr RNA) sequence.

In any of the described methods the effector protein and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. In any of the described methods the target locus of interest may be a genomic, epigenomic, or transcriptomic locus of interest. In any of the described methods the complex may be delivered with multiple guides for multiplexed use. In any of the described methods more than one protein(s) may be used.

In any of the described methods the strand break may be a single strand break or a double strand break. In preferred embodiments the double strand break may refer to the breakage of two sections of RNA, such as the two sections of RNA formed when a single strand RNA molecule has folded onto itself or putative double helices that are formed with an RNA molecule which contains self-complementary sequences allows parts of the RNA to fold and pair with itself.

Regulatory elements may comprise inducible promotors. Polynucleotides and/or vector systems may comprise inducible systems.

In any of the described methods the one or more polynucleotide molecules may be comprised in a delivery system, or the one or more vectors may be comprised in a delivery system.

In any of the described methods the non-naturally occurring or engineered composition may be delivered via liposomes, particles including nanoparticles, exosomes, microvesicles, a gene-gun or one or more viral vectors.

The invention also provides a non-naturally occurring or engineered composition which is a composition having the characteristics as discussed herein or defined in any of the herein described methods.

In certain embodiments, the invention thus provides a non-naturally occurring or engineered composition, such as particularly a composition capable of or configured to modify a target locus of interest, said composition comprising a Cas13b effector protein and one or more nucleic acid components, wherein the effector protein forms a complex with the one or more nucleic acid components and upon binding of the said complex to the locus of interest the effector protein induces the modification of the target locus of interest. In certain embodiments, the effector protein may be a Cas13b effector protein.

The invention also provides in a further aspect a non-naturally occurring or engineered composition, such as particularly a composition capable of or configured to modify a target locus of interest, said composition comprising: (a) a guide RNA molecule (or a combination of guide RNA molecules, e.g., a first guide RNA molecule and a second guide RNA molecule) or a nucleic acid encoding the guide RNA molecule (or one or more nucleic acids encoding the combination of guide RNA molecules); (b) a Cas13b effector protein. In certain embodiments, the effector protein may be a Cas13b effector protein.

The invention also provides in a further aspect a non-naturally occurring or engineered composition comprising: (I.) one or more CRISPR-Cas system polynucleotide sequences comprising (a) a guide sequence capable of hybridizing to a target sequence in a polynucleotide locus, (b) a tracr mate sequence, and (c) a tracrRNA sequence, and (II.) a second polynucleotide sequence encoding a Cas13b effector protein, wherein when transcribed, the tracr mate sequence hybridizes to the tracrRNA sequence and the guide sequence directs sequence-specific binding of a CRISPR complex to the target sequence, and wherein the CRISPR complex comprises the Cas13b effector protein complexed with (1) the guide sequence that is hybridized to the target sequence, and (2) the tracr mate sequence that is hybridized to the tracrRNA sequence. In certain embodiments, the effector protein may be a Cas13b effector protein.

In certain embodiments, a tracrRNA may not be required. Hence, the invention also provides in certain embodiments a non-naturally occurring or engineered composition comprising: (I.) one or more CRISPR-Cas system polynucleotide sequences comprising (a) a guide sequence capable of hybridizing to a target sequence in a polynucleotide locus, and (b) a direct repeat sequence, and (II.) a second polynucleotide sequence encoding a Cas13b effector protein, wherein when transcribed, the guide sequence directs sequence-specific binding of a CRISPR complex to the target sequence, and wherein the CRISPR complex comprises the Cas13b effector protein complexed with (1) the guide sequence that is hybridized to the target sequence, and (2) the direct repeat sequence. Preferably, the effector protein may be a Cas13b effector protein. Without limitation, the Applicants hypothesize that in such instances, the direct repeat sequence may comprise secondary structure that is sufficient for crRNA loading onto the effector protein. By means of example and not limitation, such secondary structure may comprise, consist essentially of or consist of a stem loop (such as one or more stem loops) within the direct repeat.

The invention also provides a vector system comprising one or more vectors, the one or more vectors comprising one or more polynucleotide molecules encoding components of a non-naturally occurring or engineered composition which is a composition having the characteristics as defined in any of the herein described methods.

The invention also provides a delivery system comprising one or more vectors or one or more polynucleotide molecules, the one or more vectors or polynucleotide molecules comprising one or more polynucleotide molecules encoding components of a non-naturally occurring or engineered composition which is a composition having the characteristics discussed herein or as defined in any of the herein described methods.

The invention also provides a non-naturally occurring or engineered composition, or one or more polynucleotides encoding components of said composition, or vector or delivery systems comprising one or more polynucleotides encoding components of said composition for use in a therapeutic method of treatment. The therapeutic method of treatment may comprise gene or genome editing, or gene therapy.

The invention also provides for methods and compositions wherein one or more amino acid residues of the effector protein may be modified e.g., an engineered or non-naturally-occurring Cas13b effector protein of or comprising or consisting essentially a Table 1A or Table 1B protein. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of one RNA strand at the target locus of interest. In a preferred embodiment, the one or more mutations may comprise two mutations. In a preferred embodiment the one or more amino acid residues are modified in the Cas13b effector protein, e.g., an engineered or non-naturally-occurring Cas13b effector protein. In certain embodiments of the invention the effector protein comprises one or more HEPN domains. In a preferred embodiment, the effector protein comprises two HEPN domains. In another preferred embodiment, the effector protein comprises one HEPN domain at the C-terminus and another HEPN domain at the N-terminus of the protein. In certain embodiments, the one or more mutations or the two or more mutations may be in a catalytically active domain of the effector protein comprising a HEPN domain, or a catalytically active domain which is homologous to a HEPN domain. In certain embodiments, the effector protein comprises one or more of the following mutations: R116A, H121A, R1177A, H1182A (wherein amino acid positions correspond to amino acid positions of Group 29 protein originating from *Bergeyella zoohelcum* ATCC 43767). The skilled person will understand that corresponding amino acid positions in different Cas13b proteins may be mutated to the same effect. In certain embodiments, one or more mutations abolish catalytic activity of the protein completely or partially (e.g. altered cleavage rate, altered specificity, etc.) In certain embodiments, the effector protein as described herein is a "dead" effector protein, such as a dead Cas13b effector protein (i.e. dCas13b). In certain embodiments, the effector protein has one or more mutations in HEPN domain 1. In certain embodiments, the effector protein has one or more mutations in HEPN domain 2. In certain embodiments, the effectyor protein has one or more mutations in HEPN domain 1 and HEPN domain 2. The effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the effector protein (e.g., Cas13b effector protein) and if two or more NLSs, each of the two may be positioned at or near or in proximity to a terminus of the effector protein (e.g., Cas13b effector protein). The one or more heterologous functional domains may comprise one or more transcriptional activation domains. In a preferred embodiment the transcriptional activation domain may comprise VP64. The one or more heterologous functional domains may comprise one or more transcriptional repression domains. In a preferred embodiment the transcriptional repression domain comprises a KRAB domain or a SID domain (e.g. SID4X). The one or more heterologous functional domains may comprise one or more nuclease domains. In a preferred embodiment a nuclease domain comprises Fok1.

The invention also provides for the one or more heterologous functional domains to have one or more of the following activities: methylase activity, demethylase activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

In certain embodiments, the Cas13b effector proteins as intended herein may be associated with a locus comprising short CRISPR repeats between 30 and 40 bp long, more typically between 34 and 38 bp long, even more typically between 36 and 37 bp long, e.g., 30, 31, 32, 33, 34, 35, 36, 37, 38, 39, or 40 bp long. In certain embodiments the CRISPR repeats are long or dual repeats between 80 and 350 bp long such as between 80 and 200 bp long, even more typically between 86 and 88 bp long, e.g., 80, 81, 82, 83, 84, 85, 86, 87, 88, 89, or 90 bp long.

In certain embodiments, a protospacer adjacent motif (PAM) or PAM-like motif directs binding of the effector protein (e.g. a Cas13b effector protein) complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). In other embodiments, both a 5' PAM and a 3' PAM are required. In certain embodiments of the invention, a PAM or PAM-like motif may not be required for directing binding of the effector protein (e.g. a Cas13b effector protein). In certain embodiments, a 5' PAM is D (i.e. A, G, or U). In certain embodiments, a 5' PAM is D for Cas13b effectors. In certain embodiments of the invention, cleavage at repeat sequences may generate crRNAs (e.g. short or long crRNAs) containing a full spacer sequence flanked by a short nucleotide (e.g. 5, 6, 7, 8, 9, or 10 nt or longer if it is a dual repeat) repeat sequence at the 5' end (this may be referred to as a crRNA "tag") and the rest of the repeat at the 3' end. In certain embodiments, targeting by the effector proteins described herein may require the lack of homology between the crRNA tag and the target 5' flanking sequence. This requirement may be similar to that described further in Samai et al. "Co-transcriptional DNA and RNA Cleavage during Type III CRISPR-Cas Immunity" Cell 161, 1164-1174, May 21, 2015, where the requirement is thought to distinguish between bona fide targets on invading nucleic acids from the CRISPR array itself, and where the presence of repeat sequences will lead to full homology with the crRNA tag and prevent autoimmunity.

In certain embodiments, Cas13b effector protein is engineered and can comprise one or more mutations that reduce or eliminate nuclease activity, thereby reducing or eliminating RNA interfering activity. Mutations can also be made at neighboring residues, e.g., at amino acids near those that participate in the nuclease activity. In some embodiments, one or more putative catalytic nuclease domains are inactivated and the effector protein complex lacks cleavage activity and functions as an RNA binding complex. In a preferred embodiment, the resulting RNA binding complex may be linked with one or more functional domains as described herein.

In certain embodiments, the one or more functional domains are controllable, i.e. inducible.

In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In preferred embodiments of the invention, the mature crRNA comprises a stem loop or an optimized stem loop structure or an optimized secondary structure. In preferred embodiments the mature crRNA comprises a stem loop or an optimized stem loop structure in the direct repeat sequence, wherein the stem loop or optimized stem loop structure is important for cleavage activity. In certain embodiments, the mature crRNA preferably comprises a single stem loop. In certain embodiments, the direct repeat sequence preferably comprises a single stem loop. In certain embodiments, the cleavage activity of the effector protein complex is modified by introducing mutations that affect the stem loop RNA duplex structure. In preferred embodiments, mutations which maintain the RNA duplex of the stem loop may be introduced, whereby the cleavage activity of the effector protein complex is maintained. In other preferred embodiments, mutations which disrupt the RNA duplex structure of the stem loop may be introduced, whereby the cleavage activity of the effector protein complex is completely abolished.

The CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, the methods make use of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

The invention also provides for the nucleotide sequence encoding the effector protein being codon optimized for expression in a eukaryote or eukaryotic cell in any of the herein described methods or compositions. In an embodiment of the invention, the codon optimized effector protein is any Cas13b effector protein discussed herein and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In certain embodiments of the invention, at least one nuclear localization signal (NLS) is attached to the nucleic acid sequences encoding the Cas13b effector proteins. In preferred embodiments at least one or more C-terminal or N-terminal NLSs are attached (and hence nucleic acid molecule(s) coding for the Cas13b effector protein can include coding for NLS(s) so that the expressed product has the NLS(s) attached or connected). In a preferred embodiment a C-terminal NLS is attached for optimal expression and nuclear targeting in eukaryotic cells, preferably human cells. The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

In a further aspect, the invention provides a eukaryotic cell comprising a modified target locus of interest, wherein the target locus of interest has been modified according to in any of the herein described methods. A further aspect provides a cell line of said cell. Another aspect provides a multicellular organism comprising one or more said cells.

In certain embodiments, the modification of the target locus of interest may result in: the eukaryotic cell comprising altered expression of at least one gene product; the eukaryotic cell comprising altered expression of at least one gene product, wherein the expression of the at least one gene product is increased; the eukaryotic cell comprising altered expression of at least one gene product, wherein the expression of the at least one gene product is decreased; or the eukaryotic cell comprising an edited genome.

In certain embodiments, the eukaryotic cell may be a mammalian cell or a human cell.

In further embodiments, the non-naturally occurring or engineered compositions, the vector systems, or the delivery systems as described in the present specification may be used for: site-specific gene knockout; site-specific genome editing; RNA sequence-specific interference; or multiplexed genome engineering.

Also provided is a gene product from the cell, the cell line, or the organism as described herein. In certain embodiments, the amount of gene product expressed may be greater than or less than the amount of gene product from a cell that does not have altered expression or edited genome. In certain embodiments, the gene product may be altered in comparison with the gene product from a cell that does not have altered expression or edited genome.

In another aspect, the invention provides a method for identifying novel nucleic acid modifying effectors, comprising: identifying putative nucleic acid modifying loci from a set of nucleic acid sequences encoding the putative nucleic acid modifying enzyme loci that are within a defined distance from a conserved genomic element of the loci, that comprise at least one protein above a defined size limit, or both; grouping the identified putative nucleic acid modifying loci into subsets comprising homologous proteins; identifying a final set of candidate nucleic acid modifying loci by selecting nucleic acid modifying loci from one or more subsets based on one or more of the following; subsets comprising loci with putative effector proteins with low domain homology matches to known protein domains relative to loci in other subsets, subsets comprising putative proteins with minimal distances to the conserved genomic element relative to loci in other subsets, subsets with loci comprising large effector proteins having a same orientations as putative adjacent accessory proteins relative to large effector proteins in other subsets, subset comprising putative effector proteins with lower existing nucleic acid modifying classifications relative to other loci, subsets comprising loci with a lower proximity to known nucleic acid modifying loci relative to other subsets, and total number of candidate loci in each subset.

In one embodiment, the set of nucleic acid sequences is obtained from a genomic or metagenomic database, such as a genomic or metagenomic database comprising prokaryotic genomic or metagenomic sequences.

In one embodiment, the defined distance from the conserved genomic element is between 1 kb and 25 kb.

In one embodiment, the conserved genomic element comprises a repetitive element, such as a CRISPR array. In a specific embodiment, the defined distance from the conserved genomic element is within 10 kb of the CRISPR array.

In one embodiment, the defined size limit of a protein comprised within the putative nucleic acid modifying (effector) locus is greater than 200 amino acids, or more particularly, the defined size limit is greater than 700 amino acids. In one embodiment, the putative nucleic acid modifying locus is between 900 to 1800 amino acids.

In one embodiment, the conserved genomic elements are identified using a repeat or pattern finding analysis of the set of nucleic acids, such as PILER-CR.

In one embodiment, the grouping step of the method described herein is based, at least in part, on results of a domain homology search or an HHpred protein domain homology search.

In one embodiment, the defined threshold is a BLAST nearest-neighbor cut-off value of 0 to 1e-7.

In one embodiment, the method described herein further comprises a filtering step that includes only loci with putative proteins between 900 and 1800 amino acids.

In one embodiment, the method described herein further comprises experimental validation of the nucleic acid modifying function of the candidate nucleic acid modifying effectors comprising generating a set of nucleic acid constructs encoding the nucleic acid modifying effectors and performing one or more biochemical validation assays, such as through the use of PAM validation in bacterial colonies, in vitro cleavage assays, the Surveyor method, experiments in mammalian cells, PFS validation, or a combination thereof.

In one embodiment, the method described herein further comprises preparing a non-naturally occurring or engineered composition comprising one or more proteins from the identified nucleic acid modifying loci.

In one embodiment, the identified loci comprise a Class 2 CRISPR effector, or the identified loci lack Cas1 or Cas2, or the identified loci comprise a single effector.

In one embodiment, the single large effector protein is greater than 900, or greater than 1100 amino acids in length, or comprises at least one HEPN domain.

In one embodiment, the at least one HEPN domain is near a N- or C-terminus of the effector protein, or is located in an interior position of the effector protein.

In one embodiment, the single large effector protein comprises a HEPN domain at the N- and C-terminus and two HEPN domains internal to the protein.

In one embodiment, the identified loci further comprise one or two small putative accessory proteins within 2 kb to 10 kb of the CRISPR array.

In one embodiment, a small accessory protein is less than 700 amino acids. In one embodiment, the small accessory protein is from 50 to 300 amino acids in length.

In one embodiment, the small accessory protein comprises multiple predicted transmembrane domains, or comprises four predicted transmembrane domains, or comprises at least one HEPN domain.

In one embodiment, the small accessory protein comprises at least one HEPN domain and at least one transmembrane domain.

In one embodiment, the loci comprise no additional proteins out to 25 kb from the CRISPR array.

In one embodiment, the CRISPR array comprises direct repeat sequences comprising about 36 nucleotides in length. In a specific embodiment, the direct repeat comprises a GTTG/GUUG at the 5' end that is reverse complementary to a CAAC at the 3' end.

In one embodiment, the CRISPR array comprises spacer sequences comprising about 30 nucleotides in length.

In one embodiment, the identified loci lack a small accessory protein.

The invention provides a method of identifying novel CRISPR effectors, comprising: a) identifying sequences in a genomic or metagenomic database encoding a CRISPR array; b) identifying one or more Open Reading Frames (ORFs) in said selected sequences within 10 kb of the CRISPR array; c) selecting loci based on the presence of a putative CRISPR effector protein between 900-1800 amino acids in size, d) selecting loci encoding a putative accessory protein of 50-300 amino acids; and e) identifying loci encoding a putative CRISPR effector and CRISPR accessory proteins and optionally classifying them based on structure analysis.

In one embodiment, the CRISPR effector is a Type VI CRISPR effector. In an embodiment, step (a) comprises i) comparing sequences in a genomic and/or metagenomic database with at least one pre-identified seed sequence that encodes a CRISPR array, and selecting sequences comprising said seed sequence; or ii) identifying CRISPR arrays based on a CRISPR algorithm.

In an embodiment, step (d) comprises identifying nuclease domains. In an embodiment, step (d) comprises identifying RuvC, HPN, and/or HEPN domains.

In an embodiment, no ORF encoding Cas1 or Cas2 is present within 10 kb of the CRISPR array.

In an embodiment, an ORF in step (b) encodes a putative accessory protein of 50-300 amino acids.

In an embodiment, putative novel CRISPR effectors obtained in step (d) are used as seed sequences for further comparing genomic and/or metagenomics sequences and subsequent selecting loci of interest as described in steps a) to d) of claim 1. In an embodiment, the pre-identified seed sequence is obtained by a method comprising: (a) identifying CRISPR motifs in a genomic or metagenomic database, (b) extracting multiple features in said identified CRISPR motifs, (c) classifying the CRISPR loci using unsupervised learning, (d) identifying conserved locus elements based on said classification, and (e) selecting therefrom a putative CRISPR effector suitable as seed sequence.

In an embodiment, the features include protein elements, repeat structure, repeat sequence, spacer sequence and spacer mapping. In an embodiment, the genomic and metagenomic databases are bacterial and/or archaeal genomes. In an embodiment, the genomic and metagenomic sequences are obtained from the Ensembl and/or NCBI genome databases. In an embodiment, the structure analysis in step (d) is based on secondary structure prediction and/or sequence alignments. In an embodiment, step (d) is achieved by clustering of the remaining loci based on the proteins they encode and manual curation of the obtained clusters.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

Figure 1A:
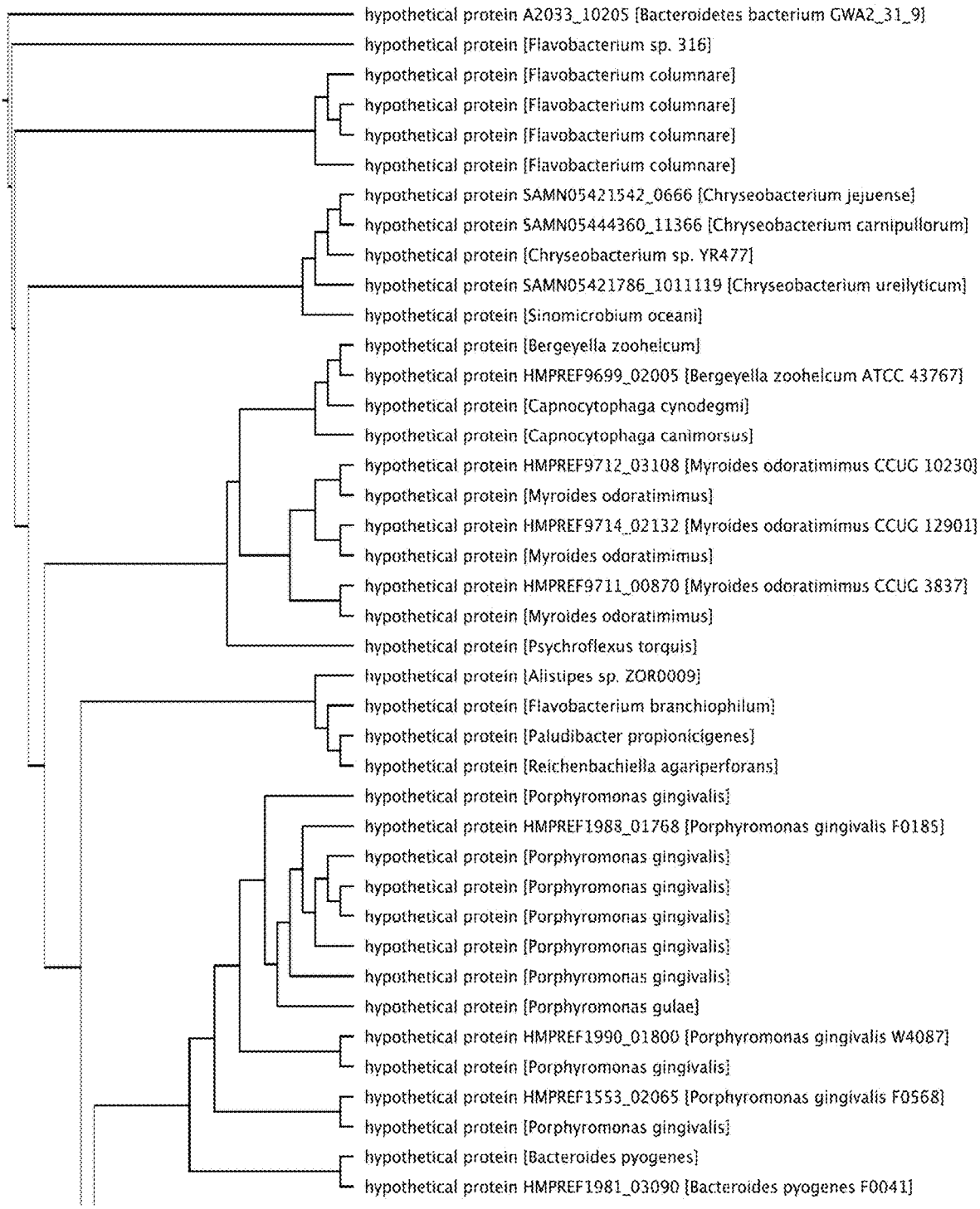
FIG. 1A-1B shows a tree alignment of Cas13b orthologs.

The figures herein are for illustrative purposes only and are not necessarily drawn to scale.

DETAILED DESCRIPTION OF THE INVENTION

In general, the CRISPR-Cas or CRISPR system refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a Class 2 Type VI-B effector, a tracrRNA is not required. In an engineered system of the invention, the direct repeat may encompass naturally-occurring sequences or nonnaturally-occurring sequences. The direct repeat of the invention is not limited to naturally occurring lengths and sequences. A direct repeat can be 36 nt in length, but a longer or shorter direct repeat can vary. For example, a direct repeat can be 30 nt or longer, such as 30-100 nt or longer. For example, a direct repeat can be 30 nt, 40 nt, 50 nt, 60 nt, 70 nt, 70 nt, 80 nt, 90 nt, 100 nt or longer in length. In some embodiments, a direct repeat of the invention can include synthetic nucleotide sequences inserted between the 5' and 3' ends of naturally occurring direct repeats. In certain embodiments, the inserted sequence may be self-complementary, for example, 20%, 30%, 40%, 50%, 60%, 70%, 80%, 90%, or 100% self complementary. Furthermore, a direct repeat of the invention may include insertions of nucleotides such as an aptamer or sequences that bind to an adapter protein (for association with functional domains). In certain embodiments, one end of a direct repeat containing such an insertion is roughly the first half of a short DR and the end is roughly the second half of the short DR.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise any polynucleotide, such as DNA or RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Cas13b effector proteins to a target locus, are used interchangeably as in herein cited documents such as WO 2014/093622 (PCT/US2013/074667). In general, a guide sequence (or spacer sequence) is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence (or spacer sequence) is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-40 nucleotides long, such as 20-30 or 20-40 nucleotides long or longer, such as 30 nucleotides long or about 30 nucleotides long. In certain embodiments, the guide sequence is 10-30 nucleotides long, such as 20-30 or 20-40 nucleotides long or longer, such as 30 nucleotides long or about 30 nucleotides long for Cas13b effectors. In certain embodiments, the guide sequence is 10-30 nucleotides long, such as 20-30 nucleotides long, such as 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

The instant invention provides particular Cas13b effectors, nucleic acids, systems, vectors, and methods of use. All VI-B are distinguishable from VI-A (Cas13b) by structure, and also by the location of the HEPN domains). There appears little that may separate Cas13b lacking the small accessory protein from Cas13b which has it, except that VI-B2 loci appear to have the small accessory protein much more conserved.

As used herein, the terms Cas13b-s1 accessory protein, Cas13b-s1 protein, Cas13b-s1, Csx27, and Csx27 protein are used interchangeably and the terms Cas13b-s2 accessory protein, Cas13b-s2 protein, Cas13b-S2, Csx28, and Csx28 protein are used interchangeably.

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or crRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or crRNA can be less than about 75, 50, 45, 40, 35, 30, 25, 20, 15, 12, or fewer nucleotides in length; and advantageously tracr RNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In particularly preferred embodiments according to the invention, the guide RNA (capable of guiding Cas to a target locus) may comprise (1) a guide sequence capable of hybridizing to a target locus (a polynucleotide target locus, such as an RNA target locus) in the eukaryotic cell; (2) a direct repeat (DR) sequence which reside in a single RNA, i.e. an sgRNA (arranged in a 5' to 3' orientation) or crRNA.

In particular embodiments, the wildtype Cas13b effector protein has RNA binding and cleaving function.

In particular embodiments, the Cas13b effector protein may have DNA cleaving function. In these embodiments, methods may be provided based on the effector proteins provided herein which comprehend inducing one or more mutations in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s) or crRNA(s). The mutations can include the introduction, deletion, or substitution of 1-75 nucleotides at each target sequence of said cell(s) via the guide(s) RNA(s) or sgRNA(s) or crRNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations can include the introduction, deletion, or substitution of 40, 45, 50, 75, 100, 200, 300, 400 or 500 nucleotides at each target sequence of said cell(s) via the guide(s) RNA(s) or sgRNA(s) or crRNAs.

For minimization of toxicity and off-target effect, it will be important to control the concentration of Cas13b mRNA and guide RNA delivered. Optimal concentrations of Cas13b mRNA and guide RNA can be determined by testing different concentrations in a cellular or non-human eukaryote animal model and using deep sequencing the analyze the extent of modification at potential off-target genomic loci. Alternatively, to minimize the level of toxicity and off-target effect, Cas13b nickase mRNA (for example S. pyogenes Cas9 with the D10A mutation) can be delivered with a pair of guide RNAs targeting a site of interest. Guide sequences and strategies to minimize toxicity and off-target effects can be as in WO 2014/093622 (PCT/US2013/074667); or, via mutation as herein.

Typically, in the context of an endogenous CRISPR system, formation of a CRISPR complex (comprising a guide sequence hybridized to a target sequence and complexed with one or more Cas proteins) results in cleavage of one or both strands (if applicable) in or near (e.g. within 1, 2, 3, 4, 5, 6, 7, 8, 9, 10, 20, 50, or more base pairs from) the target sequence.

The nucleic acid molecule encoding a Cas13b is advantageously codon optimized. An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a Cas is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.or.jp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas13b transgenic cell in which one or more nucleic acids encoding one or more guide RNAs are provided or introduced operably connected in the cell with a regulatory element comprising a promoter of one or more gene of interest. As used herein, the term "Cas13b transgenic cell" refers to a cell, such as a eukaryotic cell, in which a Cas13b gene has been genomically integrated. The nature, type, or origin of the cell are not particularly limiting according to the present invention. Also the way how the Cas13b transgene is introduced in the cell is may vary and can be any method as is known in the art. In certain embodiments, the Cas13b transgenic cell is obtained by introducing the Cas13b transgene in an isolated cell. In certain other embodiments, the Cas13b transgenic cell is obtained by isolating cells from a Cas13b transgenic organism. By means of example, and without limitation, the Cas13b transgenic cell as referred to herein may be derived from a Cas13b transgenic eukaryote, such as a Cas13b knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas13b transgene can further comprise a Lox-Stop-polyA-Lox(LSL) cassette thereby rendering Cas13b expression inducible by Cre recombinase. Alternatively, the Cas13b transgenic cell may be obtained by introducing the Cas13b transgene in an isolated cell. Delivery systems for transgenes are well known in the art. By means of example, the Cas13b transgene may be delivered in for instance eukaryotic cell by means of vector (e.g., AAV, adenovirus, lentivirus) and/or particle and/or particle delivery, as also described herein elsewhere.

It will be understood by the skilled person that the cell, such as the Cas13b transgenic cell, as referred to herein may comprise further genomic alterations besides having an integrated Cas13b gene or the mutations arising from the sequence specific action of Cas13b when complexed with RNA capable of guiding Cas13b to a target locus, such as for instance one or more oncogenic mutations, as for instance and without limitation described in Platt et al. (2014), Chen et al., (2014) or Kumar et al. (2009).

In some embodiments, the Cas13b sequence is fused to one or more nuclear localization sequences (NLSs), such as about or more than about 1, 2, 3, 4, 5, 6, 7, 8, 9, 10, or more NLSs. In some embodiments, the Cas13b comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the Cas13b comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 1); the NLS from nucleoplasmin (e.g. the nucleoplasmin bipartite NLS with the sequence KRPAATKKAGQAKKKK) (SEQ ID NO: 2); the c-myc NLS having the amino acid sequence PAAKRVKLD (SEQ ID NO: 3) or RQRRNELKRSP (SEQ ID NO: 4); the hRNPA1 M9 NLS having the sequence NQSSNFGPMKGGNFGGRSSGPYGGGGQYFAK-PRNQGGY (SEQ ID NO: 5); the sequence RMRIZFKNKGKDTAELRRRRVEVSVELRKAKKD-EQILKRRNV (SEQ ID NO: 6) of the IBB domain from importin-alpha; the sequences VSRKRPRP (SEQ ID NO: 7) and PPKKARED (SEQ ID NO: 8) of the myoma T protein; the sequence PXPKKKPL (SEQ ID NO: 9) of human p53; the sequence SALIKKKKKMAP (SEQ ID NO: 10) of mouse c-abl IV; the sequences DRLRR (SEQ ID NO: 11) and PKQKKRK (SEQ ID NO: 12) of the influenza virus NS1; the sequence RKLKKKIKKL (SEQ ID NO: 13) of the Hepatitis virus delta antigen; the sequence REKKKFLKRR (SEQ ID NO:14) of the mouse Mx1 protein; the sequence KRKGDEVDGVDEVAKKKSKK (SEQ ID NO: 15) of the human poly(ADP-ribose) polymerase; and the sequence RKCLQAGMNLEARKTKK (SEQ ID NO: 16) of the steroid hormone receptors (human) glucocorticoid. In general, the one or more NLSs are of sufficient strength to drive accumulation of the Cas in a detectable amount in the nucleus of a eukaryotic cell. In general, strength of nuclear localization activity may derive from the number of NLSs in the Cas, the particular NLS(s) used, or a combination of these factors. Detection of accumulation in the nucleus may be performed by any suitable technique. For example, a detectable marker may be fused to the Cas, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control no exposed to the Cas or complex, or exposed to a Cas lacking the one or more NLSs.

In certain aspects the invention involves vectors, e.g. for delivering or introducing in a cell Cas13b and/or RNA capable of guiding Cas13b to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas13b encoding sequence(s), and/or a single, but possibly also can comprise at least 2, 3 or 8 or 16 or 32 or 48 or 50 guide RNA(s) (e.g., crRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., crRNAs). In a single vector there can be a promoter for each RNA (e.g., crRNA(s)), advantageously when there are up to about 16 RNA(s) (e.g., crRNA(s)s); and, when a single vector provides for more than 16 RNA(s) (e.g., crRNA(s)s), one or more promoter(s) can drive expression of more than one of the RNA(s) (e.g., crRNA(s)s), e.g., when there are 32 RNA(s) (e.g., sgRNAs or crRNA(s)), each promoter can drive expression of two RNA(s) (e.g., sgRNAs or crRNA(s)), and when there are 48 RNA(s) (e.g., sgRNAs or crRNA(s)), each promoter can drive expression of three RNA(s) (e.g., sgRNAs or crRNA(s)). By simple arithmetic and well established cloning protocols and the teachings in this disclosure one skilled in the art can readily practice the invention as to the RNA(s), e.g., sgRNA(s) or crRNA(s) for a suitable exemplary vector such as AAV, and a suitable promoter such as the U6 promoter, e.g., U6-sgRNAs or -crRNA(s). For example, the packaging limit of AAV is ~4.7 kb. The skilled person can readily fit about 12-16, e.g., 13 U6-sgRNA or crRNA(s) cassettes in a single vector. This can be assembled by any suitable means, such as a golden gate strategy used for TALE assembly (http://www.genome-engineering.org/taleffectors/). The skilled person can also use a tandem guide strategy to increase the number of U6-sgRNAs or -crRNA(s) by approximately 1.5 times, e.g., to increase from 12-16, e.g., 13 to approximately 18-24, e.g., about 19 U6-sgRNAs or -crRNA(s). Therefore, one skilled in the art can readily reach approximately 18-24, e.g., about 19 promoter-RNAs, e.g., U6-sgRNAs or -crRNA(s) in a single vector, e.g., an AAV vector. A further means for increasing the number of promoters and RNAs, e.g., sgRNA(s) or crRNA(s) in a vector is to use a single promoter (e.g., U6) to express an array of RNAs, e.g., sgRNAs or crRNA(s) separated by cleavable sequences. And an even further means for increasing the number of promoter-RNAs, e.g., sgRNAs or crRNA(s) in a vector, is to express an array of promoter-RNAs, e.g., sgRNAs or crRNA(s) separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxford-journals.org/content/34/7/e53. short, www.nature.com/mt/journal/v16/n9/abs/mt2008144a.html). In an advantageous embodiment, AAV may package U6 tandem sgRNA targeting up to about 50 genes. Accordingly, from the knowledge in the art and the teachings in this disclosure the skilled person can readily make and use vector(s), e.g., a single vector, expressing multiple RNAs or guides or sgRNAs or crRNA(s) under the control or operatively or functionally linked to one or more promoters—especially as to the numbers of RNAs or guides or sgRNAs or crRNA(s) discussed herein, without any undue experimentation.

The guide RNA(s), e.g., sgRNA(s) or crRNA(s) encoding sequences and/or Cas13b encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

In an aspect of the invention, novel RNA targeting systems also referred to as RNA- or RNA-targeting CRISPR systems of the present application are based on herein-identified Cas13b proteins which do not require the generation of customized proteins to target specific RNA sequences but rather a single enzyme can be programmed by a RNA molecule to recognize a specific RNA target, in other words the enzyme can be recruited to a specific RNA target using said RNA molecule.

In some embodiments, one or more elements of a nucleic acid-targeting system is derived from a particular organism comprising an endogenous CRISPR RNA-targeting system. In certain embodiments, the CRISPR RNA-targeting system is found in *Eubacterium* and Ruminococcus. In certain embodiments, the effector protein comprises targeted and collateral ssRNA cleavage activity. In certain embodiments, the effector protein comprises dual HEPN domains. In certain embodiments, the effector protein lacks a counterpart to the Helical-1 domain of Cas13a. In certain embodiments, the effector protein is smaller than previously characterized class 2 CRISPR effectors, with a median size of 928 aa. This median size is 190 aa (17%) less than that of Cas13c, more than 200 aa (18%) less than that of Cas13b, and more than 300 aa (26%) less than that of Cas13a. In certain embodiments, the effector protein has no requirement for a flanking sequence (e.g., PFS, PAM).

In certain embodiments, the effector protein locus structures include a WYL domain containing accessory protein (so denoted after three amino acids that were conserved in the originally identified group of these domains; see, e.g., WYL domain IPR026881). In certain embodiments, the WYL domain accessory protein comprises at least one helix-turn-helix (HTH) or ribbon-helix-helix (REM) DNA-binding domain. In certain embodiments, the WYL domain containing accessory protein increases both the targeted and the collateral ssRNA cleavage activity of the RNA-targeting effector protein. In certain embodiments, the WYL domain containing accessory protein comprises an N-terminal RHH domain, as well as a pattern of primarily hydrophobic conserved residues, including an invariant tyrosine-leucine doublet corresponding to the original WYL motif. In certain embodiments, the WYL domain containing accessory protein is WYL1. WYL1 is a single WYL-domain protein associated primarily with Ruminococcus.

In other example embodiments, the Type VI RNA-targeting Cas enzyme is Cas 13d. In certain embodiments, Cas13d is *Eubacterium siraeum* DSM 15702 (EsCas13d) or *Ruminococcus* sp. N15.MGS-57 (RspCas13d) (see, e.g., Yan et al., Cas13d Is a Compact RNA-Targeting Type VI CRISPR Effector Positively Modulated by a WYL-Domain-Containing Accessory Protein, Molecular Cell (2018), doi.org/10.1016/j.molcel.2018.02.028). RspCas13d and EsCas13d have no flanking sequence requirements (e.g., PFS, PAM).

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

In an advantageous embodiment, the present invention encompasses Cas13b effector proteins with reference to Table 1A or Table 1B. A Table 1A or Table 1B Cas13b effector protein is as discussed in more detail herein in conjunction with Table 1A or Table 1B.

Cas13b Nucleases

The Cas13b effector protein of the invention is, or in, or comprises, or consists essentially of, or consists of, or involves or relates to such a protein from or as set forth in Table 1A or Table 1B. This invention is intended to provide, or relate to, or involve, or comprise, or consist essentially of, or consist of, a protein from or as set forth in Table 1A or 1B, including mutations or alterations thereof as set forth herein A Table 1A or Table 1B Cas13b effector protein is as discussed in more detail herein in conjunction with Table 1A or Table 1B.

Thus, in some embodiments, the effector protein may be a RNA-binding protein, such as a dead-Cas type effector protein, which may be optionally functionalised as described herein for instance with an transcriptional activator or repressor domain, NLS or other functional domain. In some embodiments, the effector protein may be a RNA-binding protein that cleaves a single strand of RNA. If the RNA bound is ssRNA, then the ssRNA is fully cleaved. In some embodiments, the effector protein may be a RNA-binding protein that cleaves a double strand of RNA, for example if it comprises two RNase domains. If the RNA bound is dsRNA, then the dsRNA is fully cleaved. In some embodiments, the effector protein may be a RNA-binding protein that has nickase activity, i.e. it binds dsRNA, but only cleaves one of the RNA strands.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA.

Interfering RNA (RNAi) and microRNA (miRNA)

In other embodiments, the target RNA may include interfering RNA, i.e. RNA involved in an RNA interference pathway, such as shRNA, siRNA and so forth. In other embodiments, the target RNA may include microRNA (miRNA). Control over interfering RNA or miRNA may help reduce off-target effects (OTE) seen with those approaches by reducing the longevity of the interfering RNA or miRNA in vivo or in vitro.

If the effector protein and suitable guide are selectively expressed (for example spatially or temporally under the control of a suitable promoter, for example a tissue- or cell cycle-specific promoter and/or enhancer) then this could be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The effector protein may be used to control or bind to molecules comprising or consisting of RNA, such as ribozymes, ribosomes or riboswitches. In embodiments of the invention, the RNA guide can recruit the effector protein to these molecules so that the effector protein is able to bind to them.

Ribosomal RNA (rRNA)

For example, azalide antibiotics such as azithromycin, are well known. They target and disrupt the 50S ribosomal subunit. The present effector protein, together with a suitable guide RNA to target the 50S ribosomal subunit, may be, in some embodiments, recruited to and bind to the 50S ribosomal subunit. Thus, the present effector protein in concert with a suitable guide directed at a ribosomal (especially the 50s ribosomal subunit) target is provided. Use of this use effector protein in concert with the suitable guide directed at the ribosomal (especially the 50s ribosomal subunit) target may include antibiotic use. In particular, the antibiotic use is analogous to the action of azalide antibiotics, such as azithromycin. In some embodiments, prokaryotic ribosomal subunits, such as the 70S subunit in prokaryotes, the 50S subunit mentioned above, the 30S subunit, as well as the 16S and 5S subunits may be targeted. In other embodiments, eukaryotic ribosomal subunits, such as the 80S subunit in eukaryotes, the 60S subunit, the 40S subunit, as well as the 28S, 18S. 5.8S and 5S subunits may be targeted.

The effector protein may be a RNA-binding protein, optionally functionalised, as described herein. In some embodiments, the effector protein may be a RNA-binding protein that cleaves a single strand of RNA. In either case, but particularly where the RNA-binding protein cleaves a single strand of RNA, then ribosomal function may be modulated and, in particular, reduced or destroyed. This may apply to any ribosomal RNA and any ribosomal subunit and the sequences of rRNA are well known.

Control of ribosomal activity is thus envisaged through use of the present effector protein in concert with a suitable guide to the ribosomal target. This may be through cleavage of, or binding to, the ribosome. In particular, reduction of ribosomal activity is envisaged. This may be useful in assaying ribosomal function in vivo or in vitro, but also as a means of controlling therapies based on ribosomal activity, in vivo or in vitro. Furthermore, control (i.e. reduction) of protein synthesis in an in vivo or in vitro system is envisaged, such control including antibiotic and research and diagnostic use.

Riboswitches

A riboswitch (also known as an aptozyme) is a regulatory segment of a messenger RNA molecule that binds a small molecule. This typically results in a change in production of the proteins encoded by the mRNA. Thus, control of riboswitch activity is thus envisaged through use of the present effector protein in concert with a suitable guide to the riboswitch target. This may be through cleavage of, or binding to, the riboswitch. In particular, reduction of riboswitch activity is envisaged. This may be useful in assaying riboswitch function in vivo or in vitro, but also as a means of controlling therapies based on riboswitch activity, in vivo or in vitro. Furthermore, control (i.e. reduction) of protein synthesis in an in vivo or in vitro system is envisaged. This control, as for rRNA may include antibiotic and research and diagnostic use. Ribozymes Ribozymes are RNA molecules having catalytic properties, analogous to enzymes (which are of course proteins). As ribozymes, both naturally occurring and engineered, comprise or consist of RNA, they may also be targeted by the present RNA-binding effector protein. In some embodiments, the effector protein may be a RNA-binding protein cleaves the ribozyme to thereby disable it. Control of ribozymal activity is thus envisaged through use of the present effector protein in concert with a suitable guide to the ribozymal target. This may be through cleavage of, or binding to, the ribozyme. In particular, reduction of ribozymal activity is envisaged. This may be useful in assaying ribozymal function in vivo or in vitro, but also as a means of controlling therapies based on ribozymal activity, in vivo or in vitro.

Gene Expression, Including RNA Processing

The effector protein may also be used, together with a suitable guide, to target gene expression, including via control of RNA processing. The control of RNA processing may include RNA processing reactions such as RNA splicing, including alternative splicing, via targeting of RNApol; viral replication (in particular of satellite viruses, bacteriophages and retroviruses, such as HBV, HBC and HIV and others listed herein) including viroids in plants; and tRNA biosynthesis. The effector protein and suitable guide may also be used to control RNAactivation (RNAa). RNAa leads to the promotion of gene expression, so control of gene expression may be achieved that way through disruption or reduction of RNAa and thus less promotion of gene expression.

RNAi Screens

Identifying gene products whose knockdown is associated with phenotypic changes, biological pathways can be interrogated and the constituent parts identified, via RNAi screens. Control may also be exerted over or during these screens by use of the effector protein and suitable guide to remove or reduce the activity of the RNAi in the screen and thus reinstate the activity of the (previously interfered with) gene product (by removing or reducing the interference/repression).

Satellite RNAs (satRNAs) and satellite viruses may also be treated.

Control herein with reference to RNase activity generally means reduction, negative disruption or known-down or knock out.

In Vivo RNA Applications

Inhibition of Gene Expression

The target-specific RNAses provided herein allow for very specific cutting of a target RNA. The interference at RNA level allows for modulation both spatially and temporally and in a non-invasive way, as the genome is not modified.

A number of diseases have been demonstrated to be treatable by mRNA targeting. While most of these studies relate to administration of siRNA, it is clear that the RNA targeting effector proteins provided herein can be applied in a similar way.

Examples of mRNA targets (and corresponding disease treatments) are VEGF, VEGF-R1 and RTP801 (in the treatment of AMD and/or DME), Caspase 2 (in the treatment of Naion) ADRB2 (in the treatment of intraocular pressure), TRPVI (in the treatment of Dry eye syndrome, Syk kinase (in the treatment of asthma), Apo B (in the treatment of hypercholesterolemia), PLK1, KSP and VEGF (in the treatment of solid tumors), Ber-Abl (in the treatment of CML) (Burnett and Rossi Chem Biol. 2012, 19(1): 60-71)). Similarly, RNA targeting has been demonstrated to be effective in the treatment of RNA-virus mediated diseases such as HIV (targeting of HIV Tet and Rev), RSV (targeting of RSV nucleocapsid) and HCV (targeting of miR-122) (Burnett and Rossi Chem Biol. 2012, 19(1): 60-71).

It is further envisaged that the RNA targeting effector protein of the invention can be used for mutation specific or allele specific knockdown. Guide RNA's can be designed that specifically target a sequence in the transcribed mRNA comprising a mutation or an allele-specific sequence. Such specific knockdown is particularly suitable for therapeutic applications relating to disorders associated with mutated or allele-specific gene products. For example, most cases of familial hypobetalipoproteinemia (FHBL) are caused by mutations in the ApoB gene. This gene encodes two versions of the apolipoprotein B protein: a short version (ApoB-48) and a longer version (ApoB-100). Several ApoB gene mutations that lead to FHBL cause both versions of ApoB to be abnormally short. Specifically targeting and knockdown of mutated ApoB mRNA transcripts with an RNA targeting effector protein of the invention may be beneficial in treatment of FHBL. As another example, Huntington's disease (HD) is caused by an expansion of CAG triplet repeats in the gene coding for the Huntingtin protein, which results in an abnormal protein. Specifically targeting and knockdown of mutated or allele-specific mRNA transcripts encoding the Huntingtin protein with an RNA targeting effector protein of the invention may be beneficial in treatment of HD.

It is noted that in this context, and more generally for the various applications as described herein, the use of a split version of the RNA targeting effector protein can be envisaged. Indeed, this may not only allow increased specificity but may also be advantageous for delivery. The Cas13b is split in the sense that the two parts of the Cas13b enzyme substantially comprise a functioning Cas13b. Ideally, the split should always be so that the catalytic domain(s) are unaffected. That Cas13b may function as a nuclease or it may be a dead-Cas13b which is essentially an RNA-binding protein with very little or no catalytic activity, due to typically mutation(s) in its catalytic domains.

Each half of the split Cas13b may be fused to a dimerization partner. By means of example, and without limitation, employing rapamycin sensitive dimerization domains, allows to generate a chemically inducible split Cas13b for temporal control of Cas13b activity. Cas13b can thus be rendered chemically inducible by being split into two fragments and that rapamycin-sensitive dimerization domains may be used for controlled reassembly of the Cas13b. The two parts of the split Cas13b can be thought of as the N' terminal part and the C' terminal part of the split Cas13b. The fusion is typically at the split point of the Cas13b. In other words, the C' terminal of the N' terminal part of the split Cas13b is fused to one of the dimer halves, whilst the N' terminal of the C' terminal part is fused to the other dimer half.

The Cas13b does not have to be split in the sense that the break is newly created. The split point is typically designed in silico and cloned into the constructs. Together, the two parts of the split Cas13b, the N' terminal and C' terminal parts, form a full Cas13b, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired Cas13b function is restored or reconstituted. The dimer may be a homodimer or a heterodimer.

In certain embodiments, the Cas13b effector as described herein may be used for mutation-specific, or allele-specific targeting, such as for mutation-specific, or allele-specific knockdown.

The RNA targeting effector protein can moreover be fused to another functional RNAse domain, such as a non-specific RNase or Argonaute 2, which acts in synergy to increase the RNAse activity or to ensure further degradation of the message.

Modulation of gene expression through modulation of RNA function

Apart from a direct effect on gene expression through cleavage of the mRNA, RNA targeting can also be used to impact specific aspects of the RNA processing within the cell, which may allow a more subtle modulation of gene expression. Generally, modulation can for instance be mediated by interfering with binding of proteins to the RNA, such as for instance blocking binding of proteins, or recruiting RNA binding proteins. Indeed, modulations can be ensured at different levels such as splicing, transport, localization, translation and turnover of the mRNA. Similarly in the context of therapy, it can be envisaged to address (pathogenic) malfunctioning at each of these levels by using RNA-specific targeting molecules. In these embodiments it is in many cases preferred that the RNA targeting protein is a "dead" Cas13b that has lost the ability to cut the RNA target but maintains its ability to bind thereto, such as the mutated forms of Cas13b described herein.

a) alternative splicing

Many of the human genes express multiple mRNAs as a result of alternative splicing. Different diseases have been shown to be linked to aberrant splicing leading to loss of function or gain of function of the expressed gene. While some of these diseases are caused by mutations that cause splicing defects, a number of these are not. One therapeutic option is to target the splicing mechanism directly. The RNA targeting effector proteins described herein can for instance be used to block or promote slicing, include or exclude exons and influence the expression of specific isoforms and/or stimulate the expression of alternative protein products. Such applications are described in more detail below.

A RNA targeting effector protein binding to a target RNA can sterically block access of splicing factors to the RNA sequence. The RNA targeting effector protein targeted to a splice site may block splicing at the site, optionally redirecting splicing to an adjacent site. For instance a RNA targeting effector protein binding to the 5' splice site binding can block the recruitment of the U1 component of the spliceosome, favoring the skipping of that exon. Alternatively, a RNA targeting effector protein targeted to a splicing enhancer or silencer can prevent binding of transacting regulatory splicing factors at the target site and effectively block or promote splicing. Exon exclusion can further be achieved by recruitment of ILF2/3 to precursor mRNA near an exon by an RNA targeting effector protein as described herein. As yet another example, a glycine rich domain can be attached for recruitment of hnRNP A1 and exon exclusion (Del Gatto-Konczak et al. Mol Cell Biol. 1999 January; 19(1):251-60).

In certain embodiments, through appropriate selection of gRNA, specific splice variants may be targeted, while other splice variants will not be targeted.

In some cases the RNA targeting effector protein can be used to promote slicing (e.g. where splicing is defective). For instance a RNA targeting effector protein can be associated with an effector capable of stabilizing a splicing regulatory stem-loop in order to further splicing. The RNA targeting effector protein can be linked to a consensus binding site sequence for a specific splicing factor in order to recruit the protein to the target DNA.

Examples of diseases which have been associated with aberrant splicing include, but are not limited to Paraneoplastic Opsoclonus Myoclonus Ataxia (or POMA), resulting from a loss of Nova proteins which regulate splicing of proteins that function in the synapse, and Cystic Fibrosis, which is caused by defective splicing of a cystic fibrosis transmembrane conductance regulator, resulting in the production of nonfunctional chloride channels. In other diseases aberrant RNA splicing results in gain-of-function. This is the case for instance in myotonic dystrophy which is caused by a CUG triplet-repeat expansion (from 50 to >1500 repeats) in the 3'UTR of an mRNA, causing splicing defects.

The RNA targeting effector protein can be used to include an exon by recruiting a splicing factor (such as U1) to a 5' splicing site to promote excision of introns around a desired exon. Such recruitment could be mediated trough a fusion with an arginine/serine rich domain, which functions as splicing activator (Gravely B R and Maniatis T, Mol Cell. 1998 (5):765-71).

It is envisaged that the RNA targeting effector protein can be used to block the splicing machinery at a desired locus, resulting in preventing exon recognition and the expression of a different protein product. An example of a disorder that may treated is Duchenne muscular dystrophy (DMD), which is caused by mutations in the gene encoding for the dystrophin protein. Almost all DMD mutations lead to frameshifts, resulting in impaired dystrophin translation. The RNA targeting effector protein can be paired with splice junctions or exonic splicing enhancers (ESEs) thereby preventing exon recognition, resulting in the translation of a partially functional protein. This converts the lethal Duchenne phenotype into the less severe Becker phenotype.

b) RNA Modification

RNA editing is a natural process whereby the diversity of gene products of a given sequence is increased by minor modification in the RNA. Typically, the modification involves the conversion of adenosine (A) to inosine (I), resulting in an RNA sequence which is different from that encoded by the genome. RNA modification is generally ensured by the ADAR enzyme, whereby the pre-RNA target forms an imperfect duplex RNA by base-pairing between the exon that contains the adenosine to be edited and an intronic non-coding element. A classic example of A-I editing is the glutamate receptor GluR-B mRNA, whereby the change results in modified conductance properties of the channel (Higuchi M, et al. Cell. 1993; 75:1361-70).

In humans, a heterozygous functional-null mutation in the ADARJ gene leads to a skin disease, human pigmentary genodermatosis (Miyamura Y, et al. Am J Hum Genet. 2003; 73:693-9). It is envisaged that the RNA targeting effector proteins of the present invention can be used to correct malfunctioning RNA modification.

It is further envisaged that RNA adenosine methylase (N(6)-methyladenosine) can be fused to the RNA targeting effector proteins of the invention and targeted to a transcript of interest. This methylase causes reversible methylation, has regulatory roles and may affect gene expression and cell fate decisions by modulating multiple RNA-related cellular pathways (Fu et al Nat Rev Genet. 2014; 15(5):293-306).

c) Polyadenylation

Polyadenylation of an mRNA is important for nuclear transport, translation efficiency and stability of the mRNA, and all of these, as well as the process of polyadenylation, depend on specific RBPs. Most eukaryotic mRNAs receive a 3' poly(A) tail of about 200 nucleotides after transcription. Polyadenylation involves different RNA-binding protein complexes which stimulate the activity of a poly(A)polymerase (Minvielle-Sebastia L et al. Curr Opin Cell Biol. 1999; 11:352-7). It is envisaged that the RNA-targeting effector proteins provided herein can be used to interfere with or promote the interaction between the RNA-binding proteins and RNA.

Examples of diseases which have been linked to defective proteins involved in polyadenylation are oculopharyngeal muscular dystrophy (OPMD) (Brais B, et al. Nat Genet. 1998; 18:164-7).

d) RNA Export

After pre-mRNA processing, the mRNA is exported from the nucleus to the cytoplasm. This is ensured by a cellular mechanism which involves the generation of a carrier complex, which is then translocated through the nuclear pore and releases the mRNA in the cytoplasm, with subsequent recycling of the carrier.

Overexpression of proteins (such as TAP) which play a role in the export of RNA has been found to increase export of transcripts that are otherwise inefficiently exported in Xenopus (Katahira J, et al. EMBO J. 1999; 18:2593-609).

e) mRNA Localization mRNA localization ensures spatially regulated protein production. Localization of transcripts to a specific region of the cell can be ensured by localization elements. In particular embodiments, it is envisaged that the effector proteins described herein can be used to target localization elements to the RNA of interest. The effector proteins can be designed to bind the target transcript and shuttle them to a location in the cell determined by its peptide signal tag. More particularly for instance, a RNA targeting effector protein fused to a nuclear localization signal (NLS) can be used to alter RNA localization.

Further examples of localization signals include the zipcode binding protein (ZBP1) which ensures localization of β-actin to the cytoplasm in several asymmetric cell types, KDEL retention sequence (localization to endoplasmic reticulum), nuclear export signal (localization to cytoplasm), mitochondrial targeting signal (localization to mitochondria), peroxisomal targeting signal (localization to peroxisome) and m6A marking/YTHDF2 (localization to p-bodies). Other approaches that are envisaged are fusion of the RNA targeting effector protein with proteins of known localization (for instance membrane, synapse).

Alternatively, the effector protein according to the invention may for instance be used in localization-dependent knockdown. By fusing the effector protein to a appropriate localization signal, the effector is targeted to a particular cellular compartment. Only target RNAs residing in this compartment will effectively be targeted, whereas otherwise identical targets, but residing in a different cellular compartment will not be targeted, such that a localization dependent knockdown can be established.

f) translation

The RNA targeting effector proteins described herein can be used to enhance or repress translation. It is envisaged that upregulating translation is a very robust way to control cellular circuits. Further, for functional studies a protein translation screen can be favorable over transcriptional upregulation screens, which have the shortcoming that upregulation of transcript does not translate into increased protein production.

It is envisaged that the RNA targeting effector proteins described herein can be used to bring translation initiation factors, such as EIF4G in the vicinity of the 5' untranslated repeat (5'UTR) of a messenger RNA of interest to drive translation (as described in De Gregorio et al. EMBO J. 1999; 18(17):4865-74 for a non-reprogrammable RNA binding protein). As another example GLD2, a cytoplasmic poly(A) polymerase, can be recruited to the target mRNA by an RNA targeting effector protein. This would allow for directed polyadenylation of the target mRNA thereby stimulating translation.

Similarly, the RNA targeting effector proteins envisaged herein can be used to block translational repressors of mRNA, such as ZBP1 (Huttelmaier S, et al. Nature. 2005; 438:512-5). By binding to translation initiation site of a target RNA, translation can be directly affected.

In addition, fusing the RNA targeting effector proteins to a protein that stabilizes mRNAs, e.g. by preventing degradation thereof such as RNase inhibitors, it is possible to increase protein production from the transcripts of interest.

It is envisaged that the RNA targeting effector proteins described herein can be used to repress translation by binding in the 5' UTR regions of a RNA transcript and preventing the ribosome from forming and beginning translation.

Further, the RNA targeting effector protein can be used to recruit Caf1, a component of the CCR4-NOT deadenylase complex, to the target mRNA, resulting in deadenylation or the target transcript and inhibition of protein translation.

For instance, the RNA targeting effector protein of the invention can be used to increase or decrease translation of therapeutically relevant proteins. Examples of therapeutic applications wherein the RNA targeting effector protein can be used to downregulate or upregulate translation are in amyotrophic lateral sclerosis (ALS) and cardiovascular disorders. Reduced levels of the glial glutamate transporter EAAT2 have been reported in ALS motor cortex and spinal cord, as well as multiple abnormal EAAT2 mRNA transcripts in ALS brain tissue. Loss of the EAAT2 protein and function thought to be the main cause of excitotoxicity in ALS. Restoration of EAAT2 protein levels and function may provide therapeutic benefit. Hence, the RNA targeting effector protein can be beneficially used to upregulate the expression of EAAT2 protein, e.g. by blocking translational repressors or stabilizing mRNA as described above. Apolipoprotein A1 is the major protein component of high density lipoprotein (HDL) and ApoA1 and HDL are generally considered as atheroprotective. It is envisages that the RNA targeting effector protein can be beneficially used to upregulate the expression of ApoA1, e.g. by blocking translational repressors or stabilizing mRNA as described above.

g) mRNA Turnover

Translation is tightly coupled to mRNA turnover and regulated mRNA stability. Specific proteins have been described to be involved in the stability of transcripts (such as the ELAV/Hu proteins in neurons, Keene J D, 1999, Proc Natl Acad Sci USA. 96:5-7) and tristetraprolin (TTP). These proteins stabilize target mRNAs by protecting the messages from degradation in the cytoplasm (Peng S S et al., 1988, EMBO J. 17:3461-70).

It can be envisaged that the RNA-targeting effector proteins of the present invention can be used to interfere with or to promote the activity of proteins acting to stabilize mRNA transcripts, such that mRNA turnover is affected. For instance, recruitment of human TTP to the target RNA using the RNA targeting effector protein would allow for adenylate-uridylate-rich element (AU-rich element) mediated translational repression and target degradation. AU-rich elements are found in the 3' UTR of many mRNAs that code for proto-oncogenes, nuclear transcription factors, and cytokines and promote RNA stability. As another example, the RNA targeting effector protein can be fused to HuR, another mRNA stabilization protein (Hinman M N and Lou H, Cell Mol Life Sci 2008; 65:3168-81), and recruit it to a target transcript to prolong its lifetime or stabilize short-lived mRNA.

It is further envisaged that the RNA-targeting effector proteins described herein can be used to promote degradation of target transcripts. For instance, m6A methyltransferase can be recruited to the target transcript to localize the transcript to P-bodies leading to degradation of the target.

As yet another example, an RNA targeting effector protein as described herein can be fused to the non-specific endonuclease domain PilT N-terminus (PIN), to recruit it to a target transcript and allow degradation thereof.

Patients with paraneoplastic neurological disorder (PND)-associated encephalomyelitis and neuropathy are patients who develop autoantibodies against Hu-proteins in tumors outside of the central nervous system (Szabo A et al. 1991, Cell.; 67:325-33 which then cross the blood-brain barrier. It can be envisaged that the RNA-targeting effector proteins of the present invention can be used to interfere with the binding of auto-antibodies to mRNA transcripts.

Patients with dystrophy type 1 (DM1), caused by the expansion of (CUG)n in the 3' UTR of dystrophia myotonica-protein kinase (DMPK) gene, are characterized by the accumulation of such transcripts in the nucleus. It is envisaged that the RNA targeting effector proteins of the invention fused with an endonuclease targeted to the (CUG)n repeats could inhibit such accumulation of aberrant transcripts.

h) Interaction with Multi-Functional Proteins

Some RNA-binding proteins bind to multiple sites on numerous RNAs to function in diverse processes. For instance, the hnRNP A1 protein has been found to bind exonic splicing silencer sequences, antagonizing the splicing factors, associate with telomere ends (thereby stimulating telomere activity) and bind miRNA to facilitate Drosha-mediated processing thereby affecting maturation. It is envisaged that the RNA-binding effector proteins of the present invention can interfere with the binding of RNA-binding proteins at one or more locations.

i) RNA Folding

RNA adopts a defined structure in order to perform its biological activities. Transitions in conformation among alternative tertiary structures are critical to most RNA-mediated processes. However, RNA folding can be associated with several problems. For instance, RNA may have a tendency to fold into, and be upheld in, improper alternative conformations and/or the correct tertiary structure may not be sufficiently thermodynamically favored over alternative structures. The RNA targeting effector protein, in particular a cleavage-deficient or dead RNA targeting protein, of the invention may be used to direct folding of (m)RNA and/or capture the correct tertiary structure thereof.

Use of RNA-Targeting Effector Protein in Modulating Cellular Status

In certain embodiments Cas13b in a complex with crRNA is activated upon binding to target RNA and subsequently cleaves any nearby ssRNA targets (i.e. "collateral" or "bystander" effects). Cas13b, once primed by the cognate target, can cleave other (non-complementary) RNA molecules. Such promiscuous RNA cleavage could potentially cause cellular toxicity, or otherwise affect cellular physiology or cell status.

Accordingly, in certain embodiments, the non-naturally occurring or engineered composition, vector system, or delivery systems as described herein are used for or are for use in induction of cell dormancy. In certain embodiments, the non-naturally occurring or engineered composition, vector system, or delivery systems as described herein are used for or are for use in induction of cell cycle arrest. In certain embodiments, the non-naturally occurring or engineered composition, vector system, or delivery systems as described herein are used for or are for use in reduction of cell growth and/or cell proliferation. In certain embodiments, the non-naturally occurring or engineered composition, vector system, or delivery systems as described herein are used for or are for use in induction of cell anergy. In certain embodiments, the non-naturally occurring or engineered composition, vector system, or delivery systems as described herein are used for or are for use in induction of cell apoptosis. In certain embodiments, the non-naturally occurring or engineered composition, vector system, or delivery systems as described herein are used for or are for use in induction of cell necrosis. In certain embodiments, the non-naturally occurring or engineered composition, vector system, or delivery systems as described herein are used for or are for use in induction of cell death. In certain embodiments, the non-naturally occurring or engineered composition, vector system, or delivery systems as described herein are used for or are for use in induction of programmed cell death.

In certain embodiments, the invention relates to a method for induction of cell dormancy comprising introducing or inducing the non-naturally occurring or engineered composition, vector system, or delivery systems as described herein. In certain embodiments, the invention relates to a method for induction of cell cycle arrest comprising introducing or inducing the non-naturally occurring or engineered composition, vector system, or delivery systems as described herein. In certain embodiments, the invention relates to a method for reduction of cell growth and/or cell proliferation comprising introducing or inducing the non-naturally occurring or engineered composition, vector system, or delivery systems as described herein. In certain embodiments, the invention relates to a method for induction of cell anergy comprising introducing or inducing the non-naturally occurring or engineered composition, vector system, or delivery systems as described herein. In certain embodiments, the invention relates to a method for induction of cell apoptosis comprising introducing or inducing the non-naturally occurring or engineered composition, vector system, or delivery systems as described herein. In certain embodiments, the invention relates to a method for induction of cell necrosis comprising introducing or inducing the non-naturally occurring or engineered composition, vector system, or delivery systems as described herein. In certain embodiments, the invention relates to a method for induction of cell death comprising introducing or inducing the non-naturally occurring or engineered composition, vector system, or delivery systems as described herein. In certain embodiments, the invention relates to a method for induction of programmed cell death comprising introducing or inducing the non-naturally occurring or engineered composition, vector system, or delivery systems as described herein.

The methods and uses as described herein may be therapeutic or prophylactic and may target particular cells, cell (sub)populations, or cell/tissue types. In particular, the methods and uses as described herein may be therapeutic or prophylactic and may target particular cells, cell (sub)populations, or cell/tissue types expressing one or more target sequences, such as one or more particular target RNA (e.g. ss RNA). Without limitation, target cells may for instance be cancer cells expressing a particular transcript, e.g. neurons of a given class, (immune) cells causing e.g. autoimmunity, or cells infected by a specific (e.g. viral) pathogen, etc.

Accordingly, in certain embodiments, the invention relates to a method for treating a pathological condition characterized by the presence of undesirable cells (host cells), comprising introducing or inducing the non-naturally occurring or engineered composition, vector system, or delivery systems as described herein. In certain embodiments, the invention relates the use of the non-naturally occurring or engineered composition, vector system, or delivery systems as described herein for treating a pathological condition characterized by the presence of undesirable cells (host cells). In certain embodiments, the invention relates the non-naturally occurring or engineered composition, vector system, or delivery systems as described herein for use in treating a pathological condition characterized by the presence of undesirable cells (host cells). It is to be understood that preferably the CRISPR-Cas system targets a target specific for the undesirable cells. In certain embodiments, the invention relates to the use of the non-naturally occurring or engineered composition, vector system, or delivery systems as described herein for treating, preventing, or alleviating cancer. In certain embodiments, the invention relates to the non-naturally occurring or engineered composition, vector system, or delivery systems as described herein for use in treating, preventing, or alleviating cancer. In certain embodiments, the invention relates to a method for treating, preventing, or alleviating cancer comprising introducing or inducing the non-naturally occurring or engineered composition, vector system, or delivery systems as described herein. It is to be understood that preferably the CRISPR-Cas system targets a target specific for the cancer cells. In certain embodiments, the invention relates to the use of the non-naturally occurring or engineered composition, vector system, or delivery systems as described herein for treating, preventing, or alleviating infection of cells by a pathogen. In certain embodiments, the invention relates to the non-naturally occurring or engineered composition, vector system, or delivery systems as described herein for use in treating, preventing, or alleviating infection of cells by a pathogen. In certain embodiments, the invention relates to a method for treating, preventing, or alleviating infection of cells by a pathogen comprising introducing or inducing the non-naturally occurring or engineered composition, vector system, or delivery systems as described herein. It is to be understood that preferably the CRISPR-Cas system targets a target specific for the cells infected by the pathogen (e.g. a pathogen derived target). In certain embodiments, the invention relates to the use of the non-naturally occurring or engineered composition, vector system, or delivery systems as described herein for treating, preventing, or alleviating an autoimmune disorder. In certain embodiments, the invention relates to the non-naturally occurring or engineered composition, vector system, or delivery systems as described herein for use in treating, preventing, or alleviating an autoimmune disorder. In certain embodiments, the invention relates to a method for treating, preventing, or alleviating an autoimmune disorder comprising introducing or inducing the non-naturally occurring or engineered composition, vector system, or delivery systems as described herein. It is to be understood that preferably the CRISPR-Cas system targets a target specific for the cells responsible for the autoimmune disorder (e.g. specific immune cells).

Use of RNA-Targeting Effector Protein in RNA Detection

It is further envisaged that the RNA targeting effector protein can be used in Northern blot assays. Northern blotting involves the use of electrophoresis to separate RNA samples by size. The RNA targeting effector protein can be used to specifically bind and detect the target RNA sequence.

A RNA targeting effector protein can be fused to a fluorescent protein (such as GFP) and used to track RNA localization in living cells. More particularly, the RNA targeting effector protein can be inactivated in that it no longer cleaves RNA. In particular embodiments, it is envisaged that a split RNA targeting effector protein can be used, whereby the signal is dependent on the binding of both subproteins, in order to ensure a more precise visualization. Alternatively, a split fluorescent protein can be used that is reconstituted when multiple RNA targeting effector protein complexes bind to the target transcript. It is further envisaged that a transcript is targeted at multiple binding sites along the mRNA so the fluorescent signal can amplify the true signal and allow for focal identification. As yet another alternative, the fluorescent protein can be reconstituted form a split intein.

RNA targeting effector proteins are for instance suitably used to determine the localization of the RNA or specific splice variants, the level of mRNA transcript, up- or down-regulation of transcripts and disease-specific diagnosis. The RNA targeting effector proteins can be used for visualization of RNA in (living) cells using e.g. fluorescent microscopy or flow cytometry, such as fluorescence-activated cell sorting (FACS) which allows for high-throughput screening of cells and recovery of living cells following cell sorting. Further, expression levels of different transcripts can be assessed simultaneously under stress, e.g. inhibition of cancer growth using molecular inhibitors or hypoxic conditions on cells. Another application would be to track localization of transcripts to synaptic connections during a neural stimulus using two photon microscopy.

In certain embodiments, the components or complexes according to the invention as described herein can be used in multiplexed error-robust fluorescence in situ hybridization (MERFISH; Chen et al. Science; 2015; 348(6233)), such as for instance with (fluorescently) labeled Cas13b effectors.

In Vitro Apex Labeling

Cellular processes depend on a network of molecular interactions among protein, RNA, and DNA. Accurate detection of protein-DNA and protein-RNA interactions is key to understanding such processes. In vitro proximity labeling technology employs an affinity tag combined with e.g. a photoactivatable probe to label polypeptides and RNAs in the vicinity of a protein or RNA of interest in vitro. After UV irradiation the photoactivatable group reacts with proteins and other molecules that are in close proximity to the tagged molecule, thereby labelling them. Labelled interacting molecules can subsequently be recovered and identified. The RNA targeting effector protein of the invention can for instance be used to target a probe to a selected RNA sequence.

These applications could also be applied in animal models for in vivo imaging of disease relevant applications or difficult-to culture cell types.

Use of RNA-Targeting Effector Protein in RNA Origami/In Vitro Assembly Lines—Combinatorics RNA origami refers to nanoscale folded structures for creating two-dimensional or three-dimensional structures using RNA as integrated template. The folded structure is encoded in the RNA and the shape of the resulting RNA is thus determined by the synthesized RNA sequence (Geary, et al. 2014. Science, 345 (6198). pp. 799-804). The RNA origami may act as scaffold for arranging other components, such as proteins, into complexes. The RNA targeting effector protein of the invention can for instance be used to target proteins of interest to the RNA origami using a suitable guide RNA.

These applications could also be applied in animal models for in vivo imaging of disease relevant applications or difficult-to culture cell types.

Use of RNA-Targeting Effector Protein in RNA Isolation or Purification, Enrichment or Depletion It is further envisages that the RNA targeting effector protein when complexed to RNA can be used to isolate and/or purify the RNA. The RNA targeting effector protein can for instance be fused to an affinity tag that can be used to isolate and/or purify the RNA-RNA targeting effector protein complex. Such applications are for instance useful in the analysis of gene expression profiles in cells.

In particular embodiments, it can be envisaged that the RNA targeting effector proteins can be used to target a specific noncoding RNA (ncRNA) thereby blocking its activity, providing a useful functional probe. In certain embodiments, the effector protein as described herein may be used to specifically enrich for a particular RNA (including but not limited to increasing stability, etc.), or alternatively to specifically deplete a particular RNA (such as without limitation for instance particular splice variants, isoforms, etc.).

Interrogation of lincRNA Function and Other Nuclear RNAs

Current RNA knockdown strategies such as siRNA have the disadvantage that they are mostly limited to targeting cytosolic transcripts since the protein machinery is cytosolic. The advantage of a RNA targeting effector protein of the present invention, an exogenous system that is not essential to cell function, is that it can be used in any compartment in the cell. By fusing a NLS signal to the RNA targeting effector protein, it can be guided to the nucleus, allowing nuclear RNAs to be targeted. It is for instance envisaged to probe the function of lincRNAs. Long intergenic non-coding RNAs (lincRNAs) are a vastly underexplored area of research. Most lincRNAs have as of yet unknown functions which could be studies using the RNA targeting effector protein of the invention.

Identification of RNA Binding Proteins

Identifying proteins bound to specific RNAs can be useful for understanding the roles of many RNAs. For instance, many lincRNAs associate with transcriptional and epigenetic regulators to control transcription. Understanding what proteins bind to a given lincRNA can help elucidate the components in a given regulatory pathway. A RNA targeting effector protein of the invention can be designed to recruit a biotin ligase to a specific transcript in order to label locally bound proteins with biotin. The proteins can then be pulled down and analyzed by mass spectrometry to identify them.

Assembly of Complexes on RNA and Substrate Shuttling

RNA targeting effector proteins of the invention can further be used to assemble complexes on RNA. This can be achieved by functionalizing the RNA targeting effector protein with multiple related proteins (e.g. components of a particular synthesis pathway). Alternatively, multiple RNA targeting effector proteins can be functionalized with such different related proteins and targeted to the same or adjacent target RNA. Useful application of assembling complexes on RNA are for instance facilitating substrate shuttling between proteins.

Synthetic Biology

The development of biological systems have a wide utility, including in clinical applications. It is envisaged that the programmable RNA targeting effector proteins of the invention can be used fused to split proteins of toxic domains for targeted cell death, for instance using cancer-linked RNA as target transcript. Further, pathways involving protein-protein interaction can be influenced in synthetic biological systems with e.g. fusion complexes with the appropriate effectors such as kinases or other enzymes.

Protein Splicing: Inteins

Protein splicing is a post-translational process in which an intervening polypeptide, referred to as an intein, catalyzes its own excision from the polypeptides finking it, referred to as exteins, as well as subsequent ligation of the exteins. The assembly of two or more RNA targeting effector proteins as described herein on a target transcript could be used to direct the release of a split intein (Topilina and Mills Mob DNA. 2014 Feb. 4; 5(1):5), thereby allowing for direct computation of the existence of a mRNA transcript and subsequent release of a protein product, such as a metabolic enzyme or a transcription factor (for downstream actuation of transcription pathways). This application may have significant relevance in synthetic biology (see above) or large-scale bioproduction (only produce product under certain conditions).

Inducible, Dosed and Self-Inactivating Systems

In one embodiment, fusion complexes comprising an RNA targeting effector protein of the invention and an effector component are designed to be inducible, for instance light inducible or chemically inducible. Such inducibility allows for activation of the effector component at a desired moment in time.

Light inducibility is for instance achieved by designing a fusion complex wherein CRY2 PHR/CIBN pairing is used for fusion. This system is particularly useful for light induction of protein interactions in living cells (Konermann S, et al. Nature. 2013; 500:472-476).

Chemical inducibility is for instance provided for by designing a fusion complex wherein FKBP/FRB (FK506 binding protein/FKBP rapamycin binding) pairing is used for fusion. Using this system rapamycin is required for binding of proteins (Zetsche et al. Nat Biotechnol. 2015; 33(2):139-42 describes the use of this system for Cas9).

Further, when introduced in the cell as DNA, the RNA targeting effector protein of the inventions can be modulated by inducible promoters, such as tetracycline or doxycycline controlled transcriptional activation (Tet-On and Tet-Off expression system), hormone inducible gene expression system such as for instance an ecdysone inducible gene expression system and an arabinose-inducible gene expression system. When delivered as RNA, expression of the RNA targeting effector protein can be modulated via a riboswitch, which can sense a small molecule like tetracycline (as described in Goldfless et al. Nucleic Acids Res. 2012; 40(9):e64).

In one embodiment, the delivery of the RNA targeting effector protein of the invention can be modulated to change the amount of protein or crRNA in the cell, thereby changing the magnitude of the desired effect or any undesired off-target effects.

In one embodiment, the RNA targeting effector proteins described herein can be designed to be self-inactivating. When delivered to a cell as RNA, either mRNA or as a replication RNA therapeutic (Wrobleska et al Nat Biotechnol. 2015 August; 33(8): 839-841), they can self-inactivate expression and subsequent effects by destroying the own RNA, thereby reducing residency and potential undesirable effects.

For further in vivo applications of RNA targeting effector proteins as described herein, reference is made to Mackay J P et al (Nat Struct Mol Biol. 2011 March; 18(3):256-61), Nelles et al (Bioessays. 2015 July; 37(7):732-9) and Abil Z and Zhao H (Mol Biosyst. 2015 October; 11(10):2658-65), which are incorporated herein by reference. In particular, the following applications are envisaged in certain embodiments of the invention, preferably in certain embodiments by using catalytically inactive Cas13b: enhancing translation (e.g. Cas13b—translation promotion factor fusions (e.g. eIF4 fusions)); repressing translation (e.g. gRNA targeting ribosome binding sites); exon skipping (e.g. gRNAs targeting splice donor and/or acceptor sites); exon inclusion (e.g. gRNA targeting a particular exon splice donor and/or acceptor site to be included or Cas13b fused to or recruiting spliceosome components (e.g. U1 snRNA)); accessing RNA localization (e.g. Cas13b—marker fusions (e.g. EGFP fusions)); altering RNA localization (e.g. Cas13b—localization signal fusions (e.g. NLS or NES fusions)); RNA degradation (in this case no catalytically inactive Cas13b is to be used if relied on the activity of Cas13b, alternatively and for increased specificity, a split Cas13b may be used); inhibition of non-coding RNA function (e.g. miRNA), such as by degradation or binding of gRNA to functional sites (possibly titrating out at specific sites by relocalization by Cas13b-signal sequence fusions).

As described herein before and demonstrated in the Examples, Cas13b function is robust to 5' or 3' extensions of the crRNA and to extension of the crRNA loop. It is therefore envisages that MS2 loops and other recruitment domains can be added to the crRNA without affecting complex formation and binding to target transcripts. Such modifications to the crRNA for recruitment of various effector domains are applicable in the uses of a RNA targeted effector proteins described above.

Cas13b is capable of mediating resistance to RNA phages. It is therefore envisaged that Cas13b can be used to immunize, e.g. animals, humans and plants, against RNA-only pathogens, including but not limited to Ebola virus and Zika virus.

In certain embodiments, Cas13b can process (cleave) its own array. This applies to both the wildtype Cas13b protein and the mutated Cas13b protein containing one or more mutated amino acid residues as herein-discussed. It is therefore envisaged that multiple crRNAs designed for different target transcripts and/or applications can be delivered as a single pre-crRNA or as a single transcript driven by one promotor. Such method of delivery has the advantages that it is substantially more compact, easier to synthesize and easier to delivery in viral systems. It will be understood that exact amino acid positions may vary for orthologues of a herein Cas13b can be adequately determined by protein alignment, as is known in the art, and as described herein elsewhere. Aspects of the invention also encompass methods and uses of the compositions and systems described herein in genome engineering, e.g. for altering or manipulating the expression of one or more genes or the one or more gene products, in prokaryotic or eukaryotic cells, in vitro, in vivo or ex vivo.

In an aspect, the invention provides methods and compositions for modulating, e.g., reducing, expression of a target RNA in cells. In the subject methods, a Cas13b system of the invention is provided that interferes with transcription, stability, and/or translation of an RNA.

In certain embodiments, an effective amount of Cas13b system is used to cleave RNA or otherwise inhibit RNA expression. In this regard, the system has uses similar to siRNA and shRNA, thus can also be substituted for such methods. The method includes, without limitation, use of a Cas13b system as a substitute for e.g., an interfering ribonucleic acid (such as an siRNA or shRNA) or a transcription template thereof, e.g., a DNA encoding an shRNA. The Cas13b system is introduced into a target cell, e.g., by being administered to a mammal that includes the target cell.

Advantageously, a Cas13b system of the invention is specific. For example, whereas interfering ribonucleic acid (such as an siRNA or shRNA) polynucleotide systems are plagued by design and stability issues and off-target binding, a Cas13b system of the invention can be designed with high specificity.

Destabilized Cas13b

In certain embodiments, the effector protein according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8. In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the Cas13b with one or two DDs fused to the C-terminal of the Cas13b. In some embodiments, the at least two DDs are associated with the Cas13b and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the Cas13b and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-Cas13b or DHFR-DHFR-Cas13b It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the Cas13b with the DD comprises a linker between the DD and the Cas13b. In some embodiments, the linker is a GlySer linker. In some embodiments, the DD-Cas13b further comprises at least one Nuclear Export Signal (NES). In some embodiments, the DD-Cas13b comprises two or more NESs. In some embodiments, the DD-Cas13b comprises at least one Nuclear Localization Signal (NLS). This may be in addition to an NES. In some embodiments, the Cas13b comprises or consists essentially of or consists of a localization (nuclear import or export) signal as, or as part of, the linker between the Cas13b and the DD. HA or Flag tags are also within the ambit of the invention as linkers. Applicants use NLS and/or NES as linker and also use Glycine Serine linkers as short as GS up to (GGGGS)3.

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3θ.6,7 This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a Cas13b confers to the Cas13b degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a Cas13b and its stability can be regulated or perturbed using a ligand, whereby the Cas13b has a DD. Another DD can be a 12-kDa (107-amino-acid) tag based on a mutated FKBP protein, stabilized by Shield1 ligand; see, e.g., Nature Methods 5, (2008). For instance a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282: 24866-24872; and Rodriguez, Chem Biol. Mar. 23, 2012; 19(3): 391-398—all of which are incorporated herein by reference and may be employed in the practice of the invention in selected a DD to associate with a Cas13b in the practice of this invention. As can be seen, the knowledge in the art includes a number of DDs, and the DD can be associated with, e.g., fused to, advantageously with a linker, to a Cas13b, whereby the DD can be stabilized in the presence of a ligand and when there is the absence thereof the DD can become destabilized, whereby the Cas13b is entirely destabilized, or the DD can be stabilized in the absence of a ligand and when the ligand is present the DD can become destabilized; the DD allows the Cas13b and hence the CRISPR-Cas13b complex or system to be regulated or controlled—turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand.

Cas13 Mutations

Figure 28A:
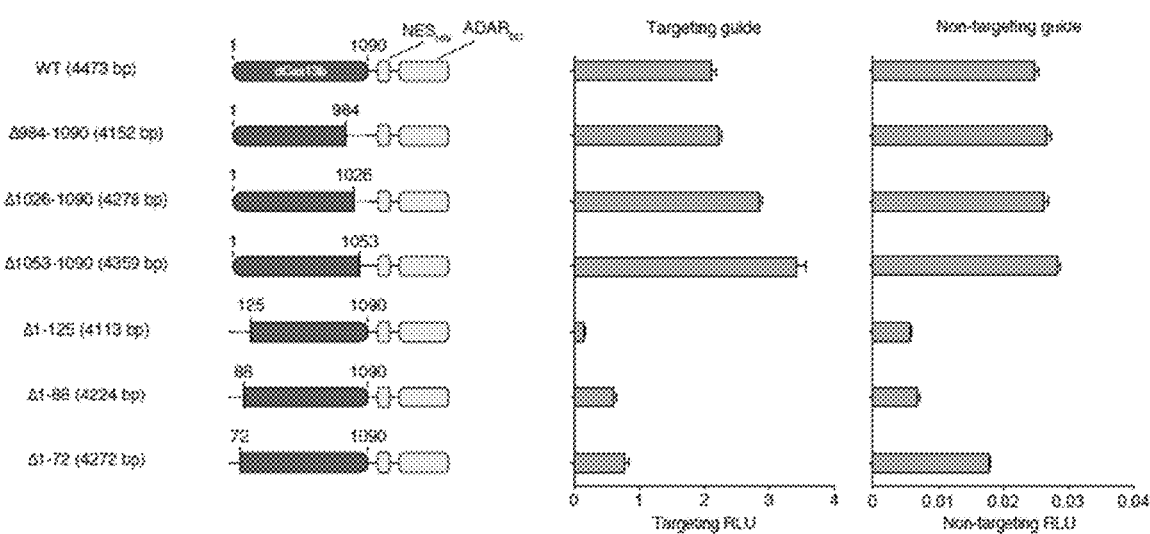
FIG. 28A-28B shows RNA binding by truncations of dCas13b. Various N-terminal and C-terminal truncations of dCas13b are depicted. RNA binding is indicated where there is ADAR-dependent RNA editing as measured by restoration of luciferase signal, comparing activity using targeting and non-targeting guides. Amino acid positions correspond to amino acid positions of *Prevotella* sp. P5-125 Cas13b protein.
Figure 28B:
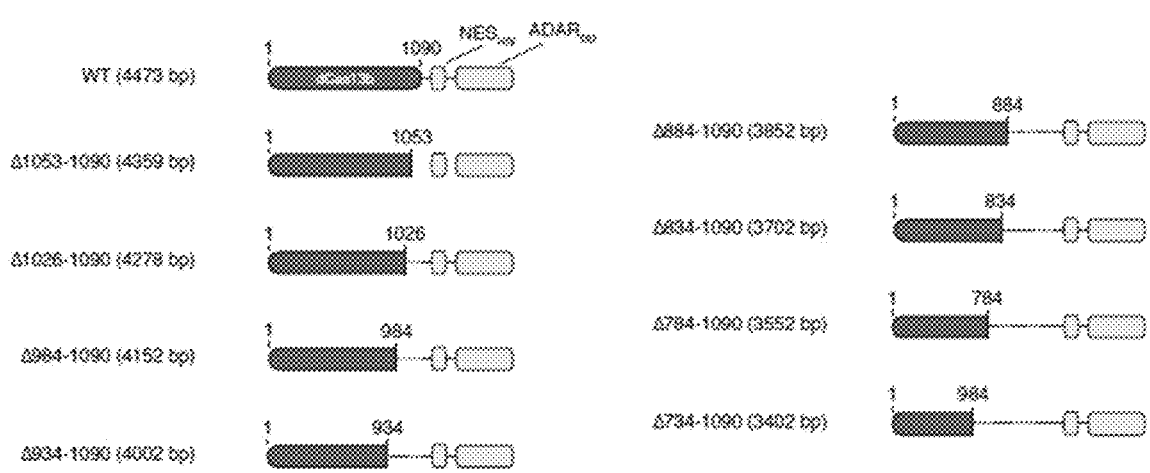
Figure 29:
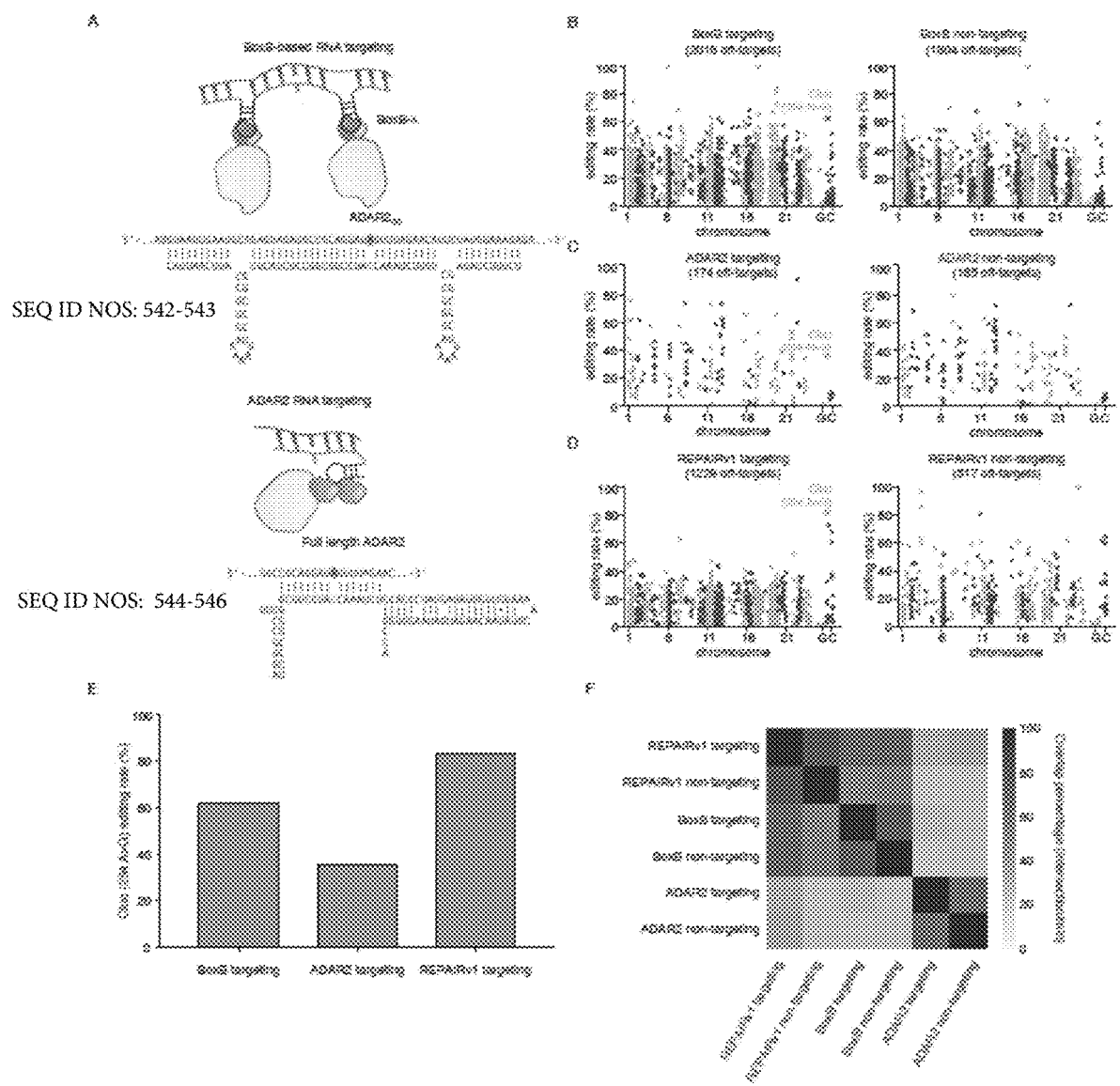
FIG. 29 shows comparison of other programmable ADAR systems with the dCas13-ADAR2 editor. A) Schematic of two programmable ADAR schemes: BoxB-based targeting and full length ADAR2 targeting. In the BoxB scheme (top), the ADAR2 deaminase domain (ADAR2$_{DD}$(E488Q)) is fused to a small bacterial virus protein called lambda N (λ N), which binds specifically a small RNA sequence called BoxB-λ. A guide RNA containing two BoxB-λ hairpins can then guide the ADAR2$_{DD}$(E488Q), -λ N for site specific editing. In the full length ADAR2 scheme (bottom), the dsRNA binding domains of ADAR2 bind a hairpin in the guide RNA, allowing for programmable ADAR2 editing. B) Transcriptome-wide sites of significant RNA editing by BoxB-ADAR2$_{DD}$(E488Q) with a guide targeting Cluc and a non-targeting guide. The on-target Cluc site (254 A>G) is highlighted in orange. C) Transcriptome-wide sites of significant RNA editing by ADAR2 with a guide targeting Cluc and a non-targeting guide. The on-target Cluc site (254 A>G) is highlighted in orange. D) Transcriptome-wide sites of significant RNA editing by REPAIRv1 with a guide targeting Cluc and a non-targeting guide. The on-target Cluc site (254 A>G) is highlighted in orange. E) Quantitation of on-target editing rate percentage for BoxB-ADAR2$_{DD}$(E488Q), ADAR2, and REPAIRv1 for targeting guides against Cluc. F) Overlap of off-target sites between different targeting and non-targeting conditions for programmable ADAR systems.
Figure 30:
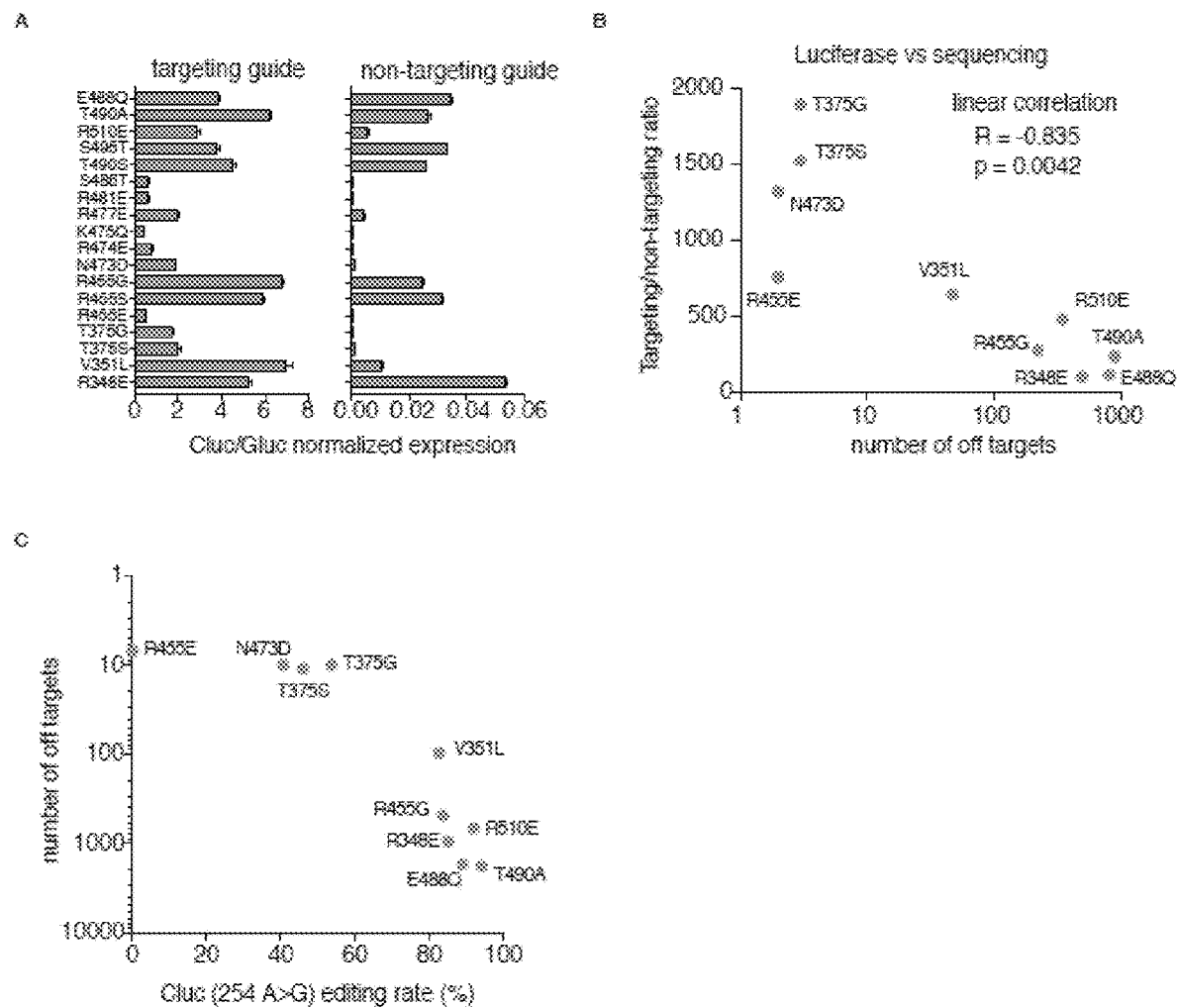
FIG. 30 shows efficiency and specificity of dCas13b-ADAR2 mutants. A) Quantitation of luciferase activity restoration by dCas13b-ADAR2$_{DD}$(E488Q) mutants for Cluc-targeting and non-targeting guides. B) Relationship between the ratio of targeting and non-targeting guides and the number of RNA-editing off-targets as quantified by transcriptome-wide sequencing. C) Quantification of number of transcriptome-wide off-target RNA editing sites versus on-target Cluc editing efficiency for dCas13b-ADAR2$_{DD}$(E488Q) mutants.

In certain embodiments, the effector protein (CRISPR enzyme; Cas13; effector protein) according to the invention as described herein is a catalytically inactive or dead Cas13 effector protein (dCas13). In some embodiments, the dCas13 effector comprises mutations in the nuclease domain. In some embodiments, the dCas13 effector protein has been truncated. To reduce the size of a fusion protein of the Cas13 effector and the one or more functional domains, the C-terminus of the Cas13 effector can be truncated while still maintaining its RNA binding function. For example, at least 20 amino acids, at least 50 amino acids, at least 80 amino acids, or at least 100 amino acids, or at least 150 amino acids, or at least 200 amino acids, or at least 250 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the C-terminus of the Cas13b effector. Specific examples of Cas13 truncations include C-terminal Δ984-1090, C-terminal Δ1026-1090, and C-terminal Δ1053-1090, C-terminal Δ934-1090, C-terminal Δ884-1090, C-terminal Δ834-1090, C-terminal Δ784-1090, and C-terminal Δ734-1090, wherein amino acid positions correspond to amino acid positions of *Prevotella* sp. P5-125 Cas13b protein. See FIG. 28.

Modulating Cas13 Effector Proteins

The invention provides accessory proteins that modulate CRISPR protein function. In certain embodiments, the accessory protein modulates catalytic activity of a CRISPR protein. In an embodiment of the invention an accessory protein modulates targeted, or sequence specific, nuclease activity. In an embodiment of the invention, an accessory protein modulates collateral nuclease activity. In an embodiment of the invention, an accessory protein modulates binding to a target nucleic acid.

According to the invention, the nuclease activity to be modulated can be directed against nucleic acids comprising or consisting of RNA, including without limitation mRNA, miRNA, siRNA and nucleic acids comprising cleavable RNA linkages along with nucleotide analogs. In an embodiment of the invention, the nuclease activity to be modulated can be directed against nucleic acids comprising or consisting of DNA, including without limitation nucleic acids comprising cleavable DNA linkages and nucleic acid analogs.

In an embodiment of the invention, an accessory protein enhances an activity of a CRISPR protein. In certain such embodiments, the accessory protein comprises a HEPN domain and enhances RNA cleavage. In certain embodiments, the accessory protein inhibits an activity of a CRISPR protein. In certain such embodiments, the accessory protein comprises an inactivated HEPN domain or lacks an HEPN domain altogether.

According to the invention, naturally occurring accessory proteins of Type VI CRISPR systems comprise small proteins encoded at or near a CRISPR locus that function to modify an activity of a CRISPR protein. In general a CRISPR locus can be identified as comprising a putative CRISPR array and/or encoding a putative CRISPR effector protein. In an embodiment, an effector protein can be from 800 to 2000 amino acids, or from 900 to 1800 amino acids, or from 950 to 1300 amino acids. In an embodiment, an accessory protein can be encoded within 25 kb, or within 20 kb or within 15 kb, or within 10 kb of a putative CRISPR effector protein or array, or from 2 kb to 10 kb from a putative CRISPR effector protein or array.

In an embodiment of the invention, an accessory protein is from 50 to 300 amino acids, or from 100 to 300 amino acids or from 150 to 250 amino acids or about 200 amino acids. Non-limiting examples of accessory proteins include the csx27 and csx28 proteins identified herein.

Identification and use of a CRISPR accessory protein of the invention is independent of CRISPR effector protein classification. Accessory proteins of the invention can be found in association with or engineered to function with a variety of CRISPR effector proteins. Examples of accessory proteins identified and used herein are representative of CRISPR effector proteins generally. It is understood that CRISPR effector protein classification may involve homology, feature location (e.g., location of REC domains, NUC domains, HEPN sequences), nucleic acid target (e.g. DNA or RNA), absence or presence of tracr RNA, location of guide/spacer sequence 5' or 3' of a direct repeat, or other criteria. In embodiments of the invention, accessory protein identification and use transcend such classifications.

In type VI CRISPR-Cas systems that target RNA, the Cas proteins usually comprise two conserved HEPN domains which are involved in RNA cleavage. In certain embodiments, the Cas protein processes crRNA to generate mature crRNA. The guide sequence of the crRNA recognizes target RNA with a complementary sequence and the Cas protein degrades the target strand. More particularly, in certain embodiments, upon target binding, the Cas protein undergoes a structural rearrangement that brings two HEPN domains together to form an active HEPN catalytic site and the target RNA is then cleaved. The location of the catalytic site near the surface of the Cas protein allows non-specific collateral ssRNA cleavage.

In certain embodiments, accessory proteins are instrumental in increasing or reducing target and/or collateral RNA cleavage. Without being bound by theory, an accessory protein that activates CRISPR activity (e.g., a csx28 protein or ortholog or variant comprising a HEPN domain) can be envisioned as capable of interacting with a Cas protein and combining its HEPN domain with a HEPN domain of the Cas protein to form an active HEPN catalytic site, whereas an inhibitory accessory protein (e.g. csx27 with lacks an HEPN domain) can be envisioned as capable of interacting with a Cas protein and reducing or blocking a conformation of the Cas protein that would bring together two HEPN domains.

According to the invention, in certain embodiments, enhancing activity of a Type VI Cas protein or complex thereof comprises contacting the Type VI Cas protein or complex thereof with an accessory protein from the same organism that activates the Cas protein. In other embodiments, enhancing activity of a Type VI Cas protein of complex thereof comprises contacting the Type VI Cas protein or complex thereof with an activator accessory protein from a different organism within the same subclass (e.g., Type VI-b). In other embodiments, enhancing activity of a Type VI Cas protein or complex thereof comprises contacting the Type VI Cas protein or complex thereof with an accessory protein not within the subclass (e.g., a Type VI Cas protein other than Type VI-b with a Type VI-b accessory protein or vice-versa).

According to the invention, in certain embodiments, repressing activity of a Type VI Cas protein or complex thereof comprises contacting the Type VI Cas protein or complex thereof with an accessory protein from the same organism that represses the Cas protein. In other embodiments, repressing activity of a Type VI Cas protein or complex thereof comprises contacting the Type VI Cas protein or complex thereof with an repressor accessory protein from a different organism within the same subclass (e.g., Type VI-b). In other embodiments, repressing activity of a Type VI Cas protein or complex thereof comprises contacting the Type VI Cas protein or complex thereof with an repressor accessory protein not within the subclass (e.g., a Type VI Cas protein other than Type VI-b with a Type VI-b repressor accessory protein or vice-versa).

In certain embodiments where the Type VI Cas protein and the Type VI accessory protein are from the same organism, the two proteins will function together in an engineered CRISPR system. In certain embodiments, it will be desirable to alter the function of the engineered CRISPR system, for example by modifying either or both of the proteins or their expression. In embodiments where the Type VI Cas protein and the Type VI accessory protein are from different organisms which may be within the same class or different classes, the proteins may function together in an engineered CRISPR system but it will often be desired or necessary to modify either or both of the proteins to function together.

Accordingly, in certain embodiments of the invention either or both of a Cas protein and an accessory protein may be modified to adjust aspects of protein-protein interactions between the Cas protein and accessory protein. In certain embodiments, either or both of a Cas protein and an accessory protein may be modified to adjust aspects of protein-nucleic acid interactions. Ways to adjust protein-protein interactions and protein-nucleic acid interaction include without limitation, fitting molecular surfaces, polar interactions, hydrogen bonds, and modulating van der Waals interactions. In certain embodiments, adjusting protein-protein interactions or protein-nucleic acid binding comprises increasing or decreasing binding interactions. In certain embodiments, adjusting protein-protein interactions or protein-nucleic acid binding comprises modifications that favor or disfavor a conformation of the protein or nucleic acid.

By "fitting", is meant determining including by automatic, or semi-automatic means, interactions between one or more atoms of a Cas13 protein and at least one atoms of a Cas13 accessory protein, or between one or more atoms of a Cas13 protein and one or more atoms of a nucleic acid, or between one or more atoms of a Cas13 accessory protein and a nucleic acid, and calculating the extent to which such interactions are stable. Interactions include attraction and repulsion, brought about by charge, steric considerations and the like.

The three-dimensional structure of Type VI CRISPR protein or complex thereof or a Type VI CRISPR accessory protein or complex thereof provides in the context of the instant invention an additional tool for identifying additional mutations in orthologs of Cas13. The crystal structure can also be basis for the design of new and specific Cas13s and Cas13 accessory proteins. Various computer-based methods for fitting are described further. Binding interactions of Cas13s, accessory proteins, and nucleic acids can be examined through the use of computer modeling using a docking program. Docking programs are known; for example GRAM, DOCK or AUTODOCK (see Walters et al. Drug Discovery Today, vol. 3, no. 4 (1998), 160-178, and Dunbrack et al. Folding and Design 2 (1997), 27-42). This procedure can include computer fitting to ascertain how well the shape and the chemical structure of the binding partners. Computer-assisted, manual examination of the active site or binding site of a Type VI system may be performed. Programs such as GRID (P. Goodford, J. Med. Chem, 1985, 28, 849-57)—a program that determines probable interaction sites between molecules with various functional groups—may also be used to analyze the active site or binding site to predict partial structures of binding compounds. Computer programs can be employed to estimate the attraction, repulsion or steric hindrance of the two binding partners, e.g., components of a Type VI CRISPR system, or a nucleic acid molecule and a component of a Type VI CRISPR system.

Amino acid substitutions may be made on the basis of differences or similarities in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. In comparing orthologs, ther are likely to be residues conserved for structural or catalytic reasons. These sets may be described in the form of a Venn diagram (Livingstone C. D. and Barton G. J. (1993) "Protein sequence alignments: a strategy for the hierarchical analysis of residue conservation" *Comput. Appl. Biosci.* 9: 745-756) (Taylor W. R. (1986) "The classification of amino acid conservation" *J. Theor. Biol.* 119; 205-218). Conservative substitutions may be made, for example according to the table below which describes a generally accepted Venn diagram grouping of amino acids.

|  | Set | Sub-set | |
|---|---|---|---|
| Hydrophobic | F W Y H K M I L V A G (SEQ ID NO: 17) | Aromatic | F W Y H (SEQ ID NO: 20) |
|  |  | Aliphatic | I L V |
| Polar | W Y H K R E D C S T N Q (SEQ ID NO: 18) | Charged | H K R E D (SEQ ID NO: 21) |
|  |  | Positively charged | H K R |
|  |  | Negatively charged | E D |
| Small | V C A G S P T N D (SEQ ID NO: 19) | Tiny | A G S |

In an engineered Cas13 system, modification may comprise modification of one or more amino acid residues of the Cas13 protein and/or may comprise modification of one or more amino acid residues of the Cas13 accessory protein.

In an engineered Cas13 system, modification may comprise modification of one or more amino acid residues located in a region which comprises residues which are positively charged in the unmodified Cas13 protein and/or Cas13 accessory protein.

In an engineered Cas13 system, modification may comprise modification of one or more amino acid residues which are positively charged in the unmodified Cas13 protein and/or Cas13 accessory protein.

In an engineered Cas13 system, modification may comprise modification of one or more amino acid residues which are not positively charged in the unmodified Cas13 protein and/or Cas13 accessory protein.

The modification may comprise modification of one or more amino acid residues which are uncharged in the unmodified Cas13 protein and/or Cas13 accessory protein.

The modification may comprise modification of one or more amino acid residues which are negatively charged in the unmodified Cas13 protein and/or Cas13 accessory protein.

The modification may comprise modification of one or more amino acid residues which are hydrophobic in the unmodified Cas13 protein and/or Cas13 accessory protein.

The modification may comprise modification of one or more amino acid residues which are polar in the unmodified Cas13 protein and/or Cas13 accessory protein.

The modification may comprise substitution of a hydrophobic amino acid or polar amino acid with a charged amino acid, which can be a negatively charged or positively charged amino acid. The modification may comprise substitution of a negatively charged amino acid with a positively charged or polar or hydrophobic amino acid. The modification may comprise substitution of a positively charged amino acid with a negatively charged or polar or hydrophobic amino acid.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyridylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., PNAS (1992) 89(20), 9367-9371 and Horwell D C, Trends Biotechnol. (1995) 13(4), 132-134.

Homology modelling: Corresponding residues in other Cas13 orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair of query proteins and using structural alignment to identify structural representatives that correspond to either their experimentally determined structures or homology models. Structural alignment is further used to identify both close and remote structural neighbours by considering global and local geometric relationships. Whenever two neighbors of the structural representatives form a complex reported in the Protein Data Bank, this defines a template for modelling the interaction between the two query proteins. Models of a complex are created by superimposing the representative structures on their corresponding structural neighbour in the template. This approach is in Dey et al., 2013 (Prot Sci; 22: 359-66).

Application of RNA Targeting-CRISPR System to Plants and Yeast

Definitions

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for modulating gene expression using the RNA targeting system as described herein can be used to confer desired traits on essentially any plant, A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include; but are not limited to, those monocotyledonous and dicotyledonous plants, such as crops including grain crops e.g., wheat, maize, rice, millet, barley), fruit crops (e.g., tomato, apple, pear, strawberry, orange), forage crops (e.g., alfalfa), root vegetable crops (e.g., carrot, potato, sugar beets, yarn), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magnoliales, Illiciales, Laurales, Piperales, Aristolochiaceae, Nymphaeales, Ranunculales, Papaveraceae, Sarraceniaceae, Trochodendrales, Hamamelidales, Eucommiae, Leitneriales, Myricales, Fagales, Casuarinaceae, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Halorgales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Liliales, and Orchid ales, or with plants belonging to Gymnospermae, e.g those belonging to the orders Pinales, Ginkgoales, Cycadales, Araucariales, Cupressales and Gnetales.

The RNA targeting CRISPR systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citruilus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium. Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis,* and *Vigna*; and the genera *Ailium, Andropogon, Eragrostis, Asparagus, Avena, Cynodon, Elaeis, Festuca, Festulolium, Hemerocallis, Hordeum, Lemna, Lolium, Musa, Oryza, Panicum, Pennisetum, Phleum, Poa, Secale, Sorghum, Triticum, Zea, Abies, Cunninghamia, Iphedra, Picea, Pinus,* and *Pseudotsuga*.

The RNA targeting CRISPR systems and methods of use can also be used over a broad range of "algae" or "algae cells"; including for example algea selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Ankistrodesmus, Botryococcus, Chaetoceros, Chlamydomonas, Chlorella, Chlorococcum, Cyclotella, Cylindrotheca, Dunaliella, Emiliana, Euglena, Haematococcus, Isochrysis, Monochrysis, Monoraphidium, Nannochloris, Nannochloropsis, Navicula, Nephrochloris, Nephroselmis, Nitzschia, Nodularia, Nostoc, Ochromonas, Oocystis, Oscillatoria, Pavlova, Phaeodactylum, Platymonas, Pleurochrysis, Porphyra Pseudoanabaena, Pyramimonas, Stichococcus, Synechococcus, Synechocystis, Tetraselmis, Thalassiosira,* and *Trichodesmium*.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendents of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerervisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and Issatchenkia spp. (e.g., *Issatchenkia orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guide-RNA may more often be a rate-limiting component in genome engineering of polyploid cells than in haploid cells, and thus the methods using the Cas13b CRISPR system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers).

Examples of expression vectors for use in yeast may include plasmids, yeast artificial chromosomes, 2p plasmids, yeast integrative plasmids, yeast replicative plasmids, shuttle vectors, and episomal plasmids.

Stable Integration of RNA Targeting CRISP System Components in the Genome of Plants and Plant Cells In particular embodiments, it is envisaged that the polynucleotides encoding the components of the RNA targeting CRISPR system are introduced for stable integration into the genome of a plant cell. In these embodiments, the design of the transformation vector or the expression system can be adjusted depending on when, where and under what conditions the guide RNA and/or the RNA targeting gene(s) are expressed.

In particular embodiments, it is envisaged to introduce the components of the RNA targeting CRISPR system stably into the genomic DNA of a plant cell. Additionally or alternatively, it is envisaged to introduce the components of the RNA targeting CRISPR system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the guide RNA and/or RNA targeting enzyme in a plant cell; a 5' untranslated region to enhance expression; an intron element to further enhance expression in certain cells, such as monocot cells; a multiple-cloning site to provide convenient restriction sites for inserting the one or more guide RNAs and/or the RNA targeting gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a RNA targeting CRISPR expression system comprises at least:
(a) a nucleotide sequence encoding a guide RNA (gRNA) that hybridizes with a target sequence in a plant, and wherein the guide RNA comprises a guide sequence and a direct repeat sequence, and
(b) a nucleotide sequence encoding a RNA targeting protein, wherein components (a) or (b) are located on the same or on different constructs, and whereby the different nucleotide sequences can be under control of the same or a different regulatory element operable in a plant cell.

DNA construct(s) containing the components of the RNA targeting CRISPR system, may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g. Klein et al, Nature (1987), Klein et al, Bio/Technology (1992), Casas et al, Proc. Natl. Acad. Sci. USA (1993).).

In particular embodiments, the DNA constructs containing components of the RNA targeting CRISPR system may be introduced into the plant by Agrobacterium-mediated transformation. The DNA constructs may be combined with suitable T-DNA flanking regions and introduced into a conventional Agrobacterium tumefaciens host vector. The foreign DNA can be incorporated into the genome of plants by infecting the plants or by incubating plant protoplasts with Agrobacterium bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the Cas13b CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. The present invention envisages methods for modifying RNA sequences and as such also envisages regulating expression of plant biomolecules. In particular embodiments of the present invention it is thus advantageous to place one or more elements of the RNA targeting CRISPR system under the control of a promoter that can be regulated. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the RNA targeting CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the RNA targeting CRISPR system—are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome), such as a Light Inducible Transcriptional Effector (LITE) that direct changes in transcriptional activity in a sequence-specific manner. The components of a light inducible system may include a RNA targeting Cas13b, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the RNA targeting CRISPR system is used to specifically modify expression and/or translation of chloroplast genes or to ensure expression in the chloroplast. For this purpose use is made of chloroplast transformation methods or compartmentalization of the RNA targeting CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO 2010/061186.

Alternatively, it is envisaged to target one or more of the RNA targeting CRISPR components to the plant chloroplast. This is achieved by incorporating in the expression construct a sequence encoding a chloroplast transit peptide (CTP) or plastid transit peptide, operably linked to the 5' region of the sequence encoding the RNA targeting protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the one or more guide RNAs to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the RNA targeting-guide RNA(s).

Introduction of Polynucleotides Encoding the CRISPR—RNA Targeting System in Alaal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardiii* cells) species) using Cas9. Using similar tools, the methods of the RNA targeting CRISPR system described herein can be applied on *Chlamydomonas* species and other algae. In particular embodiments, RNA targeting protein and guide RNA(s) are introduced in algae expressed using a vector that expresses RNA targeting protein under the control of a constitutive promoter such as Hsp70A-Rbc S2 or Beta2-tubulin. Guide RNA is optionally delivered using a vector containing T7 promoter. Alternatively, RNA targeting mRNA and in vitro transcribed guide RNA can be delivered to algal cells. Electroporation protocols are available to the skilled person such as the standard recommended protocol from the GeneArt *Chlamydomonas* Engineering kit.

Introduction of polynucleotides Encoding RNA targeting Components in Yeast Cells In particular embodiments, the invention relates to the use of the RNA targeting CRISPR system for RNA editing in yeast cells. Methods for transforming yeast cells which can be used to introduce polynucleotides encoding the RNA targeting CRISPR system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of RNA targeting CRISP System Components in Plants and Plant Cell In particular embodiments, it is envisaged that the guide RNA and/or RNA targeting gene are transiently expressed in the plant cell. In these embodiments, the RNA targeting CRISPR system can ensure modification of RNA target molecules only when both the guide RNA and the RNA targeting protein is present in a cell, such that gene expression can further be controlled. As the expression of the RNA targeting enzyme is transient, plants regenerated from such plant cells typically contain no foreign DNA. In particular embodiments the RNA targeting enzyme is stably expressed by the plant cell and the guide sequence is transiently expressed.

In particularly preferred embodiments, the RNA targeting CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., Faba bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors, which is of interest in the context of avoiding the production of GMO plants.

In particular embodiments, the vector used for transient expression of RNA targeting CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaL- CuV) vector to express gRNAs in stable transgenic plants expressing a Cas13b (see Scientific Reports 5, Article number: 14926 (2015), doi:10.1038/srep14926).

In particular embodiments, double-stranded DNA fragments encoding the guide RNA or crRNA and/or the RNA targeting gene can be transiently introduced into the plant cell. In such embodiments, the introduced double-stranded DNA fragments are provided in sufficient quantity to modify RNA molecule(s) in the cell but do not persist after a contemplated period of time has passed or after one or more cell divisions. Methods for direct DNA transfer in plants are known by the skilled artisan (see for instance Davey et al. Plant Mol Biol. 1989 September, 13(3):273-85.)

In other embodiments, an RNA polynucleotide encoding the RNA targeting protein is introduced into the plant cell, which is then translated and processed by the host cell generating the protein in sufficient quantity to modify the RNA molecule(s) cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122). Combinations of the different methods described above are also envisaged.

Delivery of RNA Targeting CRISPR Components to the Plant Cell

In particular embodiments, it is of interest to deliver one or more components of the RNA targeting CRISPR system directly to the plant cell. This is of interest, inter alia, for the generation of non-transgenic plants. In particular embodiments, one or more of the RNA targeting components is prepared outside the plant or plant cell and delivered to the cell. For instance in particular embodiments, the RNA targeting protein is prepared in vitro prior to introduction to the plant cell. RNA targeting protein can be prepared by various methods known by one of skill in the art and include recombinant production. After expression, the RNA targeting protein is isolated, refolded if needed, purified and optionally treated to remove any purification tags, such as a His-tag. Once crude, partially purified, or more completely purified RNA targeting protein is obtained, the protein may be introduced to the plant cell.

In particular embodiments, the RNA targeting protein is mixed with guide RNA targeting the RNA of interest to form a pre-assembled ribonucleoprotein.

The individual components or pre-assembled ribonucleoprotein can be introduced into the plant cell via electroporation, by bombardment with RNA targeting-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. *Nature Biotechnology*, 2015; DOI: 10. 1038/nbt.3389). These methods can be modified to achieve targeted modification of RNA molecules in the plants.

In particular embodiments, the RNA targeting CRISPR system components are introduced into the plant cells using nanoparticles. The components, either as protein or nucleic acid or in a combination thereof, can be uploaded onto or packaged in nanoparticles and applied to the plants (such as for instance described in WO 2008/042156 and US 20130185823). In particular, embodiments of the invention comprise nanoparticles uploaded with or packed with DNA molecule(s) encoding the RNA targeting protein, DNA molecules encoding the guide RNA and/or isolated guide RNA as described in WO 2015/089419.

Further means of introducing one or more components of the RNA targeting CRISPR system to the plant cell is by using cell penetrating peptides (CPP). Accordingly, in particular, embodiments the invention comprises compositions comprising a cell penetrating peptide linked to an RNA targeting protein. In particular embodiments of the present invention, an RNA targeting protein and/or guide RNA(s) is coupled to one or more CPPs to effectively transport them inside plant protoplasts (Ramakrishna (2014, Genome Res. 2014 June; 24(6):1020-7 for Cas9 in human cells). In other embodiments, the RNA targeting gene and/or guide RNA(s) are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipathic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biomolecule with the target. Examples of CPP include amongst others: Tat, a nuclear transcriptional activator protein required for viral replication by HIV type1, penetratin, Kaposi fibroblast growth factor (FGF) signal peptide sequence, integrin β3 signal peptide sequence; polyarginine peptide Args sequence, Guanine rich-molecular transporters, sweet arrow peptide, etc.

Target RNA Envisaged for Plant, Algae or Fungal appliCations

The target RNA, i.e. the RNA of interest, is the RNA to be targeted by the present invention leading to the recruitment to, and the binding of the RNA targeting protein at, the target site of interest on the target RNA. The target RNA may be any suitable form of RNA. This may include, in some embodiments, mRNA. In other embodiments, the target RNA may include transfer RNA (tRNA) or ribosomal RNA (rRNA). In other embodiments the target RNA may include interfering RNA (RNAi), microRNA (miRNA), microswitches, microzymes, satellite RNAs and RNA viruses. The target RNA may be located in the cytoplasm of the plant cell, or in the cell nucleus or in a plant cell organelle such as a mitochondrion, chloroplast or plastid.

In particular embodiments, the RNA targeting CRISPR system is used to cleave RNA or otherwise inhibit RNA expression.

Use of RNA Targeting CRISPR System for Modulating Plant Gene Expression Via RNA Modulation The RNA targeting protein may also be used, together with a suitable guide RNA, to target gene expression, via control of RNA processing. The control of RNA processing may include RNA processing reactions such as RNA splicing, including alternative splicing; viral replication in particular of plant viruses, including viroids in plants and tRNA biosynthesis. The RNA targeting protein in combination with a suitable guide RNA may also be used to control RNA activation (RNAa). RNAa leads to the promotion of gene expression, so control of gene expression may be achieved that way through disruption or reduction of RNAa and thus less promotion of gene expression.

The RNA targeting effector protein of the invention can further be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), Cauliflower mosaic virus (CaMV) (RI virus), Plum pox virus (PPV), Brome mosaic virus (BMV) and Potato virus X (PVX).

Examples of modulating RNA expression in plants, algae or fungi, as an alternative of targeted gene modification are described herein further.

Of particular interest is the regulated control of gene expression through regulated. cleavage of mRNA. This can be achieved by placing elements of the RNA targeting under the control of regulated promoters as described herein.

Use of the RNA Targeting CRISPR System to Restore the Functionality of tRNA Molecules.

Pring et al describe RNA editing in plant mitochondria and chloroplasts that alters mRNA sequences to code for different proteins than the DNA. (Plant Mol. Biol. (1993) 21 (6): 1163-1170. doi:10.1007/BF00023611). In particular embodiments of the invention, the elements of the RNA targeting CRISPR system specifically targeting mitochondrial and chloroplast mRNA can be introduced in a plant or plant cell to express different proteins in such plant cell organelles mimicking the processes occurring in vivo.

Use of the RNA Targeting CRISPR System as an Alternative to RNA Interference to Inhibit RNA Expression.

The RNA targeting CRISPR system has uses similar to RNA inhibition or RNA interference, thus can also be substituted for such methods. In particular embodiment, the methods of the present invention include the use of the RNA targeting CRISPR as a substitute for e.g. an interfering ribonucleic acid (such as an siRNA or shRNA or a dsRNA). Examples of inhibition of RNA expression in plants, algae or fungi as an alternative of targeted gene modification are described herein further.

Use of the RNA Targeting CRISPR System to Control RNA Interference.

Control over interfering RNA or miRNA may help reduce off-target effects (OTE) seen with those approaches by reducing the longevity of the interfering RNA or miRNA in vivo or in vitro. In particular embodiments, the target RNA may include interfering RNA, i.e. RNA involved in an RNA interference pathway, such as shRNA, siRNA and so forth. In other embodiments, the target RNA may include microRNA (miRNA) or double stranded RNA (dsRNA).

In other particular embodiments, if the RNA targeting protein and suitable guide RNA(s) are selectively expressed (for example spatially or temporally under the control of a regulated promoter, for example a tissue- or cell cycle-specific promoter and/or enhancer) this can be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The RNA targeting protein may be used to control or bind to molecules comprising or consisting of RNA, such as ribozymes, ribosomes or riboswitches. In embodiments of the invention, the guide RNA can recruit the RNA targeting protein to these molecules so that the RNA targeting protein is able to bind to them.

The RNA targeting CRISPR system of the invention can be applied in areas of in-planta RNAi technologies, without undue experimentation, from this disclosure, including insect pest management, plant disease management and management of herbicide resistance, as well as in plant assay and for other applications (see, for instance Kim et al., in Pesticide Biochemistry and Physiology (Impact Factor: 2.01). 01/2015; 120. DOI: 10.1016/j.pestbp.2015.01.002; Sharma et al. in Academic Journals (2015), Vol. 12(18) pp 2303-2312); Green J. M, in Pest Management Science, Vol 70(9), pp 1351-1357), because the present application provides the foundation for informed engineering of the system.

Use of RNA Targeting CRISPR System to Modify Riboswitches and Control Metabolic Regulation in Plants, Algae and Fungi Riboswitches (also known as aptozymes) are regulatory segments of messenger RNA that bind small molecules and in turn regulate gene expression. This mechanism allows the cell to sense the intracellular concentration of these small molecules. A particular riboswitch typically regulates its adjacent gene by altering the transcription, the translation or the splicing of this gene. Thus, in particular embodiments of the present invention, control of riboswitch activity is envisaged through the use of the RNA targeting protein in combination with a suitable guide RNA to target the riboswitch. This may be through cleavage of, or binding to, the riboswitch. In particular embodiments, reduction of riboswitch activity is envisaged. Recently, a riboswitch that binds thiamin pyrophosphate (TPP) was characterized and found to regulate thiamin biosynthesis in plants and algae. Furthermore it appears that this element is an essential regulator of primary metabolism in plants (Bocobza and Aharoni, Plant J. 2014 August; 79(4):693-703. doi: 10.1111/tpj.12540. Epub 2014 Jun. 17). TPP riboswitches are also found in certain fungi, such as in *Neurospora crassa*, where it controls alternative splicing to conditionally produce an Upstream Open Reading Frame (uORF), thereby affecting the expression of downstream genes (Cheah M T et al., (2007) Nature 447 (7143): 497-500. doi:10.1038/nature05769) The RNA targeting CRISPR system described herein may be used to manipulate the endogenous riboswitch activity in plants, algae or fungi and as such alter the expression of downstream genes controlled by it. In particular embodiments, the RNA targeting CRISP system may be used in assaying riboswitch function in vivo or in vitro and in studying its relevance for the metabolic network. In particular embodiments the RNA targeting CRISPR system may potentially be used for engineering of riboswitches as metabolite sensors in plants and platforms for gene control.

Use of RNA Targeting CRISPR System in RNAi Screens for Plants, Algae or Fungi

Identifying gene products whose knockdown is associated with phenotypic changes, biological pathways can be interrogated and the constituent parts identified, via RNAi screens. In particular embodiments of the invention, control may also be exerted over or during these screens by use of the Guide 29 or Guide 30 protein and suitable guide RNA described herein to remove or reduce the activity of the RNAi in the screen and thus reinstate the activity of the (previously interfered with) gene product (by removing or reducing the interference/repression).

Use of RNA Targeting Proteins for Visualization of RNA Molecules In Vivo and In Vitro In particular embodiments, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. As such, labelled elements of the RNA targeting system can be used as an alternative for efficient and adaptable system for in situ hybridization.

Further Applications of the RNA Targeting CRISPR System in Plants and Yeasts

Use of RNA Targeting CRISPR System in Biofuel Production

The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the RNA targeting CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008/064289 A2.

In particular embodiments, the methods described herein are used to produce plant mass that produces lower levels of acetic acid during fermentation (see also WO 2010/096488).

Modifying Yeast for Biofuel Production

In particular embodiments, the RNA targeting enzyme provided herein is used for bioethanol production by recombinant micro-organisms. For instance, RNA targeting enzymes can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the RNA targeting CRISPR complex is used to modify the expression of endogenous genes required for biofuel production and/or to modify endogenous genes why may interfere with the biofuel synthesis. More particularly the methods involve stimulating the expression in a micro-organism such as a yeast of one or more nucleotide sequence encoding enzymes involved in the conversion of pyruvate to ethanol or another product of interest. In particular embodiments the methods ensure the stimulation of expression of one or more enzymes which allows the micro-organism to degrade cellulose, such as a cellulase. In yet further embodiments, the RNA targeting CRISPR complex is used to suppress endogenous metabolic pathways which compete with the biofuel production pathway.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, the RNA targeting effector protein and guide RNA are introduced in algae expressed using a vector that expresses the RNA targeting effector protein under the control of a constitutive promoter such as Hsp70A-Rbc S2 or Beta2-tubulin. Guide RNA will be delivered using a vector containing T7 promoter. Alternatively, in vitro transcribed guide RNA can be delivered to algae cells. Electroporation protocol follows standard recommended protocol from the GeneArt *Chlamydomonas* Engineering kit.

Particular Applications of the RNA Targeting Enzymes in Plants

In particular embodiments, present invention can be used as a therapy for virus removal in plant systems as it is able to cleave viral RNA. Previous studies in human systems have demonstrated the success of utilizing CRISPR in targeting the single strand RNA virus, hepatitis C (A. Price, et al., Proc. Natl. Acad. Sci, 2015). These methods may also be adapted for using the RNA targeting CRISPR system in plants.

Improved Plants

The present invention also provides plants and yeast cells obtainable and obtained by the methods provided herein. The improved plants obtained by the methods described herein may be useful in food or feed production through the modified expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In an embodiment of the invention, a Cas13b system is used to engineer pathogen resistant plants, for example by creating resistance against diseases caused by bacteria, fungi or viruses. In certain embodiments, pathogen resistance can be accomplished by engineering crops to produce a Cas13b system that will be ingested by an insect pest, leading to mortality. In an embodiment of the invention, a Cas13b system is used to engineer abiotic stress tolerance. In another embodiment, a Cas13b system is used to engineer drought stress tolerance or salt stress tolerance, or cold or heat stress tolerance. Younis et al. 2014, Int. J. Biol. Sci. 10; 1150 reviewed potential targets of plant breeding methods, all of which are amenable to correction or improvement through use of a Cas13b system described herein. Some non-limiting target crops include *Arabidopsis Zea mays* is *thaliana*, *Oryza sativa* L, *Prunus domestica* L., *Gossypium hirsutum*, *Nicotiana rustica*, *Zea mays*, *Medicago sativa*, *Nicotiana benthamiana* and *Arabidopsis thaliana*.

In an embodiment of the invention, a Cas13b system is used for management of crop pests. For example, a Cas13b system operable in a crop pest can be expressed from a plant host or transferred directly to the target, for example using a viral vector.

In an embodiment, the invention provides a method of efficiently producing homozygous organisms from a heterozygous non-human starting organism. In an embodiment, the invention is used in plant breeding. In another embodiment, the invention is used in animal breeding. In such embodiments, a homozygous organism such as a plant or animal is made by preventing or suppressing recombination by interfering with at least one target gene involved in double strand breaks, chromosome pairing and/or strand exchange.

Application of the CAS13B Proteins in Optimized Functional RNA Targeting Systems In an aspect the invention provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc. Applications of this system are described elsewhere herein.

According to one aspect the invention provides non-naturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the Cas13b enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas complex having at least three functional domains, at least one of which is associated with the RNA targeting enzyme and at least two of which are associated with the gRNA.

Accordingly, in an aspect the invention provides non-naturally occurring or engineered CRISPR-Cas13b complex composition comprising the guide RNA as herein-discussed and a Cas13b which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a Cas13b enzyme which has a diminished nuclease activity of at least 97%, or 100% as compared with the Cas13b enzyme not having the at least one mutation. In an aspect the invention provides a herein-discussed composition, wherein the Cas13b enzyme comprises two or more mutations as otherwise herein-discussed.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains.

In an aspect the invention provides a herein-discussed composition, wherein the one or more functional domains associated with the adaptor protein or the RNA targeting enzyme is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell.

In an aspect the invention provides a herein above-discussed composition wherein there is more than one guide RNA or gRNA or crRNA, and these target different sequences whereby when the composition is employed, there is multiplexing. In an aspect the invention provides a composition wherein there is more than one guide RNA or gRNA or crRNA modified by the insertion of distinct RNA sequence(s) that bind to one or more adaptor proteins.

In an aspect the invention provides a herein-discussed composition wherein one or more adaptor proteins associated with one or more functional domains is present and bound to the distinct RNA sequence(s) inserted into the guide RNA(s).

In an aspect the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect the invention provides a method for modifying gene expression comprising the administration to a host or expression in a host in vivo of one or more of the compositions as herein-discussed.

In an aspect the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a lentivirus, an adenovirus, or an AAV.

In an aspect the invention provides a mammalian cell line of cells as herein-discussed, wherein the cell line is, optionally, a human cell line or a mouse cell line. In an aspect the invention provides a transgenic mammalian model, optionally a mouse, wherein the model has been transformed with a herein-discussed composition or is a progeny of said transformant.

In an aspect the invention provides a nucleic acid molecule(s) encoding guide RNA or the RNA targeting CRISPR-Cas13b complex or the composition as herein-discussed. In an aspect the invention provides a vector comprising: a nucleic acid molecule encoding a guide RNA (gRNA) or crRNA comprising a guide sequence capable of hybridizing to an RNA target sequence in a cell, wherein the direct repeat of the gRNA or crRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect the invention provides vector(s) comprising nucleic acid molecule(s) encoding: non-naturally occurring or engineered CRISPR-Cas13b complex composition comprising the gRNA or crRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect a vector can further comprise regulatory element(s) operable in a eukaryotic cell operably linked to the nucleic acid molecule encoding the guide RNA (gRNA) or crRNA and/or the nucleic acid molecule encoding the RNA targeting enzyme and/or the optional nuclear localization sequence(s).

In one aspect, the invention provides a kit comprising one or more of the components described herein. In some embodiments, the kit comprises a vector system as described herein and instructions for using the kit.

In an aspect the invention provides a method of screening for gain of function (GOF) or loss of function (LOF) or for screening non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA or crRNA includes either an activator or a repressor, and monitoring for GOF or LOF respectively as to those cells as to which the introduced gRNA or crRNA includes an activator or as to those cells as to which the introduced gRNA or crRNA includes a repressor.

In an aspect the invention provides a library of non-naturally occurring or engineered compositions, each comprising a RNA targeting CRISPR guide RNA (gRNA) or crRNA comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA or crRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs or crRNAs comprise a genome wide library comprising a plurality of RNA targeting guide RNAs (gRNAs) or crRNAs. In an aspect the invention provides a library as herein-discussed, wherein the RNA targeting RNA targeting enzyme has a diminished nuclease activity of at least 97%, or 100% as compare with the RNA targeting enzyme not having the at least one mutation. In an aspect the invention provides a library as herein-discussed, wherein the adaptor protein is a fusion protein comprising the functional domain. In an aspect the invention provides a library as herein discussed, wherein the gRNA or crRNA is not modified by the insertion of distinct RNA sequence(s) that bind to the one or two or more adaptor proteins. In an aspect the invention provides a library as herein discussed, wherein the one or two or more functional domains are associated with the RNA targeting enzyme. In an aspect the invention provides a library as herein discussed, wherein the cell population of cells is a population of eukaryotic cells. In an aspect the invention provides a library as herein discussed, wherein the eukaryotic cell is a mammalian cell, a plant cell or a yeast cell. In an aspect the invention provides a library as herein discussed, wherein the mammalian cell is a human cell. In an aspect the invention provides a library as herein discussed, wherein the population of cells is a population of embryonic stem (ES) cells.

In an aspect the invention provides a library as herein discussed, wherein the targeting is of about 100 or more RNA sequences. In an aspect the invention provides a library as herein discussed, wherein the targeting is of about 1000 or more RNA sequences. In an aspect the invention provides a library as herein discussed, wherein the targeting is of about 20,000 or more sequences. In an aspect the invention provides a library as herein discussed, wherein the targeting is of the entire transcriptome. In an aspect the invention provides a library as herein discussed, wherein the targeting is of a panel of target sequences focused on a relevant or desirable pathway. In an aspect the invention provides a library as herein discussed, wherein the pathway is an immune pathway. In an aspect the invention provides a library as herein discussed, wherein the pathway is a cell division pathway.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA or crRNA interaction with the target RNA and the RNA targeting enzyme permitting engineering or alteration of guide RNA structure to optimize functionality of the entire RNA targeting CRISPR-Cas13b system. For example, the guide RNA or crRNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the genomic level.

The skilled person will understand that modifications to the guide RNA or crRNA which allow for binding of the adapter+functional domain but not proper positioning of the adapter+functional domain (e.g. due to steric hindrance within the three dimensial structure of the CRISPR Cas13b complex) are modifications which are not intended. The one or more modified guide RNA or crRNA may be modified, by introduction of a distinct RNA sequence(s) 5' of the direct repeat, within the direct repeat, or 3' of the guide sequence.

The modified guide RNA or crRNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA or crRNA selection) and concentration of gRNA or crRNA (e.g. dependent on whether multiple gRNAs or crRNAs are used) may be advantageous for eliciting an improved effect.

Using the provided compositions, the person skilled in the art can advantageously and specifically target single or multiple loci with the same or different functional domains to elicit one or more genomic events. The compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR Cas13b RNA targeting events. (See, e.g., Platt et al., Cell (2014), http://dx.doi.org/10.1016/j.cell.2014.09.014, or PCT patent publications cited herein, such as WO 2014/093622 (PCT/US2013/074667), which are not believed prior to the present invention or application).

Guide RNA According to the Invention Comprising a Dead Guide Sequence

In one aspect, the invention provides guide sequences which are modified in a manner which allows for formation of the CRISPR Cas13b complex and successful binding to the target, while at the same time, not either allowing for or not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting enzyme as described herein, and guide RNA (gRNA) or crRNA wherein the gRNA or crRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system.. It is to be understood that any of the gRNAs or crRNAs according to the invention as described herein elsewhere may be used as dead gRNAs/crRNAs comprising a dead guide sequence.

The ability of a dead guide sequence to direct sequence-specific binding of a CRISPR complex to an RNA target sequence may be assessed by any suitable assay. For example, the components of a CRISPR Cas13b system sufficient to form a CRISPR Cas13b complex, including the dead guide sequence to be tested, may be provided to a host cell having the corresponding target sequence, such as by transfection with vectors encoding the components of the system, followed by an assessment of preferential cleavage within the target sequence.

As explained further herein, several structural parameters allow for a proper framework to arrive at such dead guides. Dead guide sequences can be typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA or crRNA-RNA targeting specificity is the direct repeat sequence, which is to be appropriately linked to such guides. In particular, this implies that the direct repeat sequences are designed dependent on the origin of the RNA targeting enzyme. Structural data available for validated dead guide sequences may be used for designing Cas13b specific equivalents. Structural similarity between, e.g., the orthologous nuclease domains HEPN of two or more Cas13b effector proteins may be used to transfer design equivalent dead guides. Thus, the dead guide herein may be appropriately modified in length and sequence to reflect such Cas13b specific equivalents, allowing for formation of the CRISPR Cas13b complex and successful binding to the target RNA, while at the same time, not allowing for successful nuclease activity.

Dead guides allow one to use gRNA or crRNA as a means for gene targeting, without the consequence of nuclease activity, while at the same time providing directed means for activation or repression. Guide RNA or crRNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA or crRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

General Information

In embodiments of the invention the terms guide sequence and guide RNA and crRNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long, such as 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

As used herein, the term "crRNA" or "guide RNA" or "single guide RNA" or "sgRNA" or "one or more nucleic acid components" of a Type VI CRISPR-Cas locus effector protein comprises any polynucleotide sequence having sufficient complementarity with a target nucleic acid sequence to hybridize with the target nucleic acid sequence and direct sequence-specific binding of a RNA-targeting complex to the target RNA sequence.

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, guides of the invention comprise non-naturally occurring nucleic acids and/or non-naturally occurring nucleotides and/or nucleotide analogs, and/or chemically modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, boranophosphate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified bases include, but are not limited to, 2-aminopurine, 5-bromo-uridine, pseudouridine (Ψ), N1-methylpseudouridine (melΨ), 5-methoxyuridine (5 moU), inosine, 7-methylguanosine. Examples of guide RNA chemical modifications include, without limitation, incorporation of 2'-O-methyl (M), 2'-O-methyl 3'phosphorothioate (MS), S-constrained ethyl (cEt), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015; Allerson et al., J. Med. Chem. 2005, 48:901-904; Bramsen et al., Front. Genet., 2012, 3:154; Deng et al., PNAS, 2015, 112:11870-11875; Sharma et al., Med Chem Comm., 2014, 5:1454-1471; Li et al., Nature Biomedical Engineering, 2017, 1, 0066 DOI:10.1038/s41551-017-0066).

In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233: 74-83). In certain embodiments, a guide comprises ribonucleotides in a region that binds to a target DNA and one or more deoxyribonucleotides and/or nucleotide analogs in a region that binds to Cas9, Cpf1, or C2c1. In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 5'-handle of the stem-loop regions. Chemical modification in the 5'-handle of the stem-loop region of a guide may abolish its function (see Li, et al., Nature Biomedical Engineering, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), or 2'-O-methyl-3'-thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., eLife, 2017, 6:e25312, DOI:10.7554).

In one aspect of the invention, the guide comprises a modified crRNA for Cpf1, having a 5'-handle and a guide segment further comprising a seed region and a 3'-terminus. In some embodiments, the modified guide can be used with a Cpf1 of any one of Acidaminococcus sp. BV3L6 Cpf1 (AsCpf1); *Francisella tularensis* subsp. *Novicida* U112 Cpf1 (FnCpf1); *L. bacterium* MC2017 Cpf1 (Lb3Cpf1); *Butyrivibrio proteoclasticus* Cpf1 (BpCpf1); Parcubacteria bacterium GWC2011_GWC2_44_17 Cpf1 (PbCpf1); Peregrinibacteria bacterium GW2011_GWA_33_10 Cpf1 (PeCpf1); Leptospira inadai Cpf1 (LiCpf1); Smithella sp. SC_K08D17 Cpf1 (SsCpf1); *L. bacterium* MA2020 Cpf1 (Lb2Cpf1); *Porphyromonas* crevioricanis Cpf1 (PcCpf1); *Porphyromonas macacae* Cpf1 (PmCpf1); Candidatus Methanoplasma termitum Cpf1 (CMtCpf1); *Eubacterium eligens* Cpf1 (EeCpf1); *Moraxella* bovoculi 237 Cpf1 (MbCpf1); *Prevotella disiens* Cpf1 (PdCpf1); or *L. bacterium* ND2006 Cpf1 (LbCpf1).

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromouridine, pseudouridine (Ψ), N1-methylpseudouridine (melΨ), 5-methoxyuridine (5 moU), inosine, 7-methylguanosine, 2'-O-methyl-3'-phosphorothioate (MS), S-constrained ethyl(cEt), phosphorothioate (PS), or 2'-O-methyl-3'-thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 3'-terminus are chemically modified. Such chemical modifications at the 3'-terminus of the Cpf1 CrRNA improve gene cutting efficiency (see Li, et al., Nature Biomedical Engineering, 2017, 1:0066). In a specific embodiment, 5 nucleotides in the 3'-terminus are replaced with 2'-fluoro analogues. In a specific embodiment, 10 nucleotides in the 3'-terminus are replaced with 2'-fluoro analogues. In a specific embodiment, 5 nucleotides in the 3'-terminus are replaced with 2'-O-methyl (M) analogs.

In some embodiments, the loop of the 5'-handle of the guide is modified. In some embodiments, the loop of the 5'-handle of the guide is modified to have a deletion, an insertion, a split, or chemical modifications. In certain embodiments, the loop comprises 3, 4, or 5 nucleotides. In certain embodiments, the loop comprises the sequence of UCUU, UUUU, UAUU, or UGUU.

In one aspect, the guide comprises portions that are chemically linked or conjugated via a non-phosphodiester bond. In one aspect, the guide comprises, in non-limiting examples, a tracr sequence and a tracr mate sequence portion or a direct repeat and a targeting sequence portion that are chemically linked or conjugated via a non-nucleotide loop. In some embodiments, the portions are joined via a non-phosphodiester covalent linker. Examples of the covalent linker include but are not limited to a chemical moiety selected from the group consisting of carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, portions of the guide are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, the non-targeting guide portions can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sufonyl, ally, propargyl, diene, alkyne, and azide. Once a non-targeting portions of a guide is functionalized, a covalent chemical bond or linkage can be formed between the two oligonucleotides. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cycloaddition pairs or ring-closing metathesis pairs, and Michael reaction pairs.

In some embodiments, one or more portions of a guide can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317: 3-18) or 2'-thionocarbamate (2'-TC) chemistry (Dellinger et al., J. Am. Chem. Soc. (2011) 133: 11540-11546; Hendel et al., Nat. Biotechnol. (2015) 33:985-989).

In some embodiments, the guide portions can be covalently linked using various bioconjugation reactions, loops, bridges, and non-nucleotide links via modifications of sugar, internucleotide phosphodiester bonds, purine and pyrimidine residues. Sletten et al., Angew. Chem. Int. Ed. (2009) 48:6974-6998; Manoharan, M. Curr. Opin. Chem. Biol. (2004) 8: 570-9; Behlke et al., Oligonucleotides (2008) 18: 305-19; Watts, et al., Drug. Discov. Today (2008) 13: 842-55; Shukla, et al., Chem Med Chem (2010) 5: 328-49.

In some embodiments, the guide portions can be covalently linked using click chemistry. In some embodiments, guide portions can be covalently linked using a triazole linker. In some embodiments, guide portions can be covalently linked using Huisgen 1,3-dipolar cycloaddition reaction involving an alkyne and azide to yield a highly stable triazole linker (He et al., Chem Bio Chem (2015) 17: 1809-1812; WO 2016/186745). In some embodiments, guide portions are covalently linked by ligating a 5'-hexyne portion and a 3'-azide portion. In some embodiments, either or both of the 5'-hexyne guide portion and a 3'-azide guide portion can be protected with 2'-acetoxyethyl orthoester (2'-ACE) group, which can be subsequently removed using Dharmacon protocol (Scaringe et al., J. Am. Chem. Soc. (1998) 120: 11820-11821; Scaringe, Methods Enzymol. (2000) 317: 3-18).

In some embodiments, guide portions can be covalently linked via a linker (e.g., a non-nucleotide loop) that comprises a moiety such as spacers, attachments, bioconjugates, chromophores, reporter groups, dye labeled RNAs, and non-naturally occurring nucleotide analogues. More specifically, suitable spacers for purposes of this invention include, but are not limited to, polyethers (e.g., polyethylene glycols, polyalcohols, polypropylene glycol or mixtures of ethylene and propylene glycols), polyamines group (e.g., spennine, spermidine and polymeric derivatives thereof), polyesters (e.g., poly(ethyl acrylate)), polyphosphodiesters, alkylenes, and combinations thereof. Suitable attachments include any moiety that can be added to the linker to add additional properties to the linker, such as but not limited to, fluorescent labels. Suitable bioconjugates include, but are not limited to, peptides, glycosides, lipids, cholesterol, phospholipids, diacyl glycerols and dialkyl glycerols, fatty acids, hydrocarbons, enzyme substrates, steroids, biotin, digoxigenin, carbohydrates, polysaccharides. Suitable chromophores, reporter groups, and dye-labeled RNAs include, but are not limited to, fluorescent dyes such as fluorescein and rhodamine, chemiluminescent, electrochemiluminescent, and bioluminescent marker compounds. The design of example linkers conjugating two RNA components are also described in WO 2004/015075.

The linker (e.g., a non-nucleotide loop) can be of any length. In some embodiments, the linker has a length equivalent to about 0-16 nucleotides. In some embodiments, the linker has a length equivalent to about 0-8 nucleotides. In some embodiments, the linker has a length equivalent to about 0-4 nucleotides. In some embodiments, the linker has a length equivalent to about 2 nucleotides. Example linker design is also described in WO 2011/008730.

In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within a RNA-targeting guide RNA or crRNA) to direct sequence-specific binding of a nucleic acid-targeting complex to a target nucleic acid sequence may be assessed by any suitable assay. For example, the components of a RNA-targeting CRISPR Cas13b system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a RNA-targeting guide RNA or crRNA may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a RNA-targeting guide RNA or crRNA is selected to reduce the degree secondary structure within the RNA-targeting guide RNA or crRNA. In some embodiments, about or less than about 75%, 50%, 40%, 30%, 25%, 20%, 15%, 10%, 5%, 1%, or fewer of the nucleotides of the RNA-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNA fold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence. In other embodiments, multiple DRs (such as dual DRs) may be present.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

The "tracrRNA" sequence or analogous terms includes any polynucleotide sequence that has sufficient complementarity with a crRNA sequence to hybridize. In general, degree of complementarity is with reference to the optimal alignment of the sca sequence and tracr sequence, along the length of the shorter of the two sequences. Optimal alignment may be determined by any suitable alignment algorithm, and may further account for secondary structures, such as self-complementarity within either the sca sequence or tracr sequence. In some embodiments, the degree of complementarity between the tracr sequence and sca sequence along the length of the shorter of the two when optimally aligned is about or more than about 25%, 30%, 40%, 50%, 60%, 70%, 80%, 90%, 95%, 97.5%, 99%, or higher. In certain embodiments, the tracrRNA may not be required. Indeed, the Cas13b effector protein from *Bergeyella zoohelcum* and orthologs thereof do not require a tracrRNA to ensure cleavage of an RNA target.

In further detail, the assay is as follows for a RNA target, provided that a PAM sequence is required to direct recognition. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the RNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12h after transformation, all colonies formed by the test and control strains where harvested and plasmid RNA was isolated. Plasmid RNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM. In particular embodiments, the cleavage, such as the RNA cleavage is not PAM dependent. Indeed, for the *Bergeyella zoohelcum* effector protein and its orthologs, RNA target cleavage appears to be PAM independent, and hence the Table 1A or Table 1B Cas13b of the invention may act in a PAM independent fashion.

For minimization of toxicity and off-target effect, it will be important to control the concentration of RNA-targeting guide RNA delivered. Optimal concentrations of nucleic acid—targeting guide RNA can be determined by testing different concentrations in a cellular or non-human eukaryote animal model and using deep sequencing the analyze the extent of modification at potential off-target genomic loci. The concentration that gives the highest level of on-target modification while minimizing the level of off-target modification should be chosen for in vivo delivery. The RNA-targeting system is derived advantageously from a CRISPR-Cas13b system. In some embodiments, one or more elements of a RNA-targeting system is derived from a particular organism comprising an endogenous RNA-targeting system of a Table 1A or Table 1B Cas13b effector protein system as herein-discussed.

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. In particular embodiments, the homologue or orthologue of a Cas13b protein as referred to herein has a sequence homology or identity of at least 80%, more preferably at least 85%, even more preferably at least 90%, such as for instance at least 95% with a Cas13b effector protein set forth in Table 1A or Table 1B, below. In a preferred embodiment, the Cas13b effector protein may be of or from an organism identified in Table 1A or Table 1B or the genus to which the organism belongs.

It has been found that a number of Cas13b orthologs are characterized by common motifs. Accordingly, in particular embodiments, the Cas13b effector protein is a protein comprising a sequence having at least 70% sequence identity with one or more of the sequences consisting of DKHXFGAFLNLARHN (SEQ ID NO: 22), GLLFFVSLFLDK (SEQ ID NO: 23), SKIXGFK (SEQ ID NO: 24), DMLNELXRCP (SEQ ID NO: 25), RXZDRFPYFALRYXD (SEQ ID NO: 26) and LRFQVBLGXY (SEQ ID NO: 27). In further particular embodiments, the Cas13b effector protein comprises a sequence having at least 70% sequence identity at least 2, 3, 4, 5 or all 6 of these sequences. In further particular embodiments, the sequence identity with these sequences is at least 75%, 80%, 85%, 90%, 95% or 100%. In further particular embodiments, the Cas13b effector protein is a protein comprising a sequence having 100% sequence identity with GLLFFVSLFL (SEQ ID NO: 28) and RHQXRFPYF (SEQ ID NO: 29). In further particular embodiments, the Cas13b effector is a Cas13b effector protein comprising a sequence having 100% sequence identity with RHQDRFPY (SEQ ID NO: 30).

In particular embodiments, the Cas13b effector protein is a Cas13b effector protein having at least 65%, preferably at least 70%, 75%, 80%, 85%, 90%, 95% or more sequence identity with a Cas13b protein from *Prevotella buccae, Porphyromonas gingivalis, Prevotella saccharolytica, Riemerella anatipestifer*. In further particular embodiments, the Cas13b effector is selected from the Cas13b protein from *Bacteroides pyogenes, Prevotella* sp. MA2016, *Riemerella anatipestifer, Porphyromonas gulae, Porphyromonas gingivalis*, and *Porphyromonas* sp. COT-0520H4946.

It will be appreciated that orthologs of a Table 1A or Table 1B Cas13b enzyme that can be within the invention can include a chimeric enzyme comprising a fragment of a Table 1A or Table 1B Cas13b enzyme multiple orthologs. Examples of such orthologs are described elsewhere herein. A chimeric enzyme may comprise a fragment of a Table 1A or Table 1B Cas13b enzyme and a fragment from another CRISPR enzyme, such as an ortholog of a Table 1A or Table 1B Cas13b enzyme of an organism which includes but is not limited to Bergeyella, *Prevotella, Porphyromonas, Bacteroides, Alistipes, Riemerella, Myroides, Flavobacterium, Capnocytophaga, Chryseobacterium, Phaeodactylibacter, Paludibacter* or *Psychroflexus*. A chimeric enzyme can comprise a first fragment and a second fragment, and the fragments, wherein one of the first and second a fragment is of or from a Table 1A or Table 1B Cas13b enzyme and the other fragment is of or from a CRISPR enzyme ortholog of a different species.

In embodiments, the Cas13b RNA-targeting Cas13b effector proteins referred to herein also encompasses a functional variant of the effector protein or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc., including as discussed herein in conjunction with Table 1A or Table 1B. Also included within functional variants are fusion products of such protein with another, usually unrelated, nucleic acid, protein, polypeptide or peptide. Functional variants may be naturally occurring or may be man-made. In an embodiment, nucleic acid molecule(s) encoding the Cas13b RNA-targeting effector proteins, or an ortholog or homolog thereof, may be codon-optimized for expression in an eukaryotic cell. A eukaryote can be as herein discussed. Nucleic acid molecule(s) can be engineered or non-naturally occurring.

In an embodiment, the Cas13b RNA-targeting effector protein or an ortholog or homolog thereof, may comprise one or more mutations. The mutations may be artificially introduced mutations and may include but are not limited to one or more mutations in a catalytic domain, e.g., one or more mutations are introduced ino one or more of the HEPN domains.

In an embodiment, the Cas13b protein or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In some embodiments, the unmodified RNA-targeting effector protein (Cas13b) may have cleavage activity. In some embodiments, Cas13b may direct cleavage of one or two nucleic acid strands at the location of or near a target sequence, such as within the target sequence and/or within the complement of the target sequence or at sequences associated with the target sequence, e.g., within about 1, 2, 3, 4, 5, 6, 7, 8, 9, 10, 15, 20, 25, 50, 100, 200, 500, or more base pairs from the first or last nucleotide of a target sequence. In some embodiments, the Cas13b protein may direct more than one cleavage (such as one, two three, four, five, or more cleavages) of one or two strands within the target sequence and/or within the complement of the target sequence or at sequences associated with the target sequence and/or within about 1, 2, 3, 4, 5, 6, 7, 8, 9, 10, 15, 20, 25, 50, 100, 200, 500, or more base pairs from the first or last nucleotide of a target sequence. In some embodiments, the cleavage may be blunt, i.e., generating blunt ends. In some embodiments, the cleavage may be staggered, i.e., generating sticky ends. In some embodiments, a vector encodes a nucleic acid-targeting Cas13b protein that may be mutated with respect to a corresponding wild-type enzyme such that the mutated nucleic acid-targeting Cas13b protein lacks the ability to cleave one or two strands of a target polynucleotide containing a target sequence, e.g., alteration or mutation in a HEPN domain to produce a mutated Cas13b substantially lacking all RNA cleavage activity, e.g., the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. By derived, Applicants mean that the derived enzyme is largely based, in the sense of having a high degree of sequence homology with, a wildtype enzyme, but that it has been mutated (modified) in some way as known in the art or as described herein.

Typically, in the context of an endogenous RNA-targeting system, formation of a RNA-targeting complex (comprising a guide RNA or crRNA hybridized to a target sequence and complexed with one or more RNA-targeting effector proteins) results in cleavage of RNA strand(s) in or near (e.g., within 1, 2, 3, 4, 5, 6, 7, 8, 9, 10, 20, 50, or more base pairs from) the target sequence. As used herein the term "sequence(s) associated with a target locus of interest" refers to sequences near the vicinity of the target sequence (e.g. within 1, 2, 3, 4, 5, 6, 7, 8, 9, 10, 20, 50, or more base pairs from the target sequence, wherein the target sequence is comprised within a target locus of interest).

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., Cas13b) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a RNA-targeting Cas13b protein is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.or.jp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid.

The (i) Cas13b or nucleic acid molecule(s) encoding it or (ii) crRNA can be delivered separately; and advantageously at least one or both of one of (i) and (ii), e.g., an assembled complex is delivered via a particle or nanoparticle complex. RNA-targeting effector protein mRNA can be delivered prior to the RNA-targeting guide RNA or crRNA to give time for nucleic acid-targeting effector protein to be expressed. RNA-targeting effector protein (Cas13b) mRNA might be administered 1-12 hours (preferably around 2-6 hours) prior to the administration of RNA-targeting guide RNA or crRNA. Alternatively, RNA-targeting effector protein mRNA and RNA-targeting guide RNA or crRNA can be administered together. Advantageously, a second booster dose of guide RNA or crRNA can be administered 1-12 hours (preferably around 2-6 hours) after the initial administration of RNA-targeting effector (Cas13b) protein mRNA+guide RNA. Additional administrations of RNA-targeting effector protein mRNA and/or guide RNA or crRNA might be useful to achieve the most efficient levels of genome modification.

In one aspect, the invention provides methods for using one or more elements of a RNA-targeting system. The RNA-targeting complex of the invention provides an effective means for modifying a target RNA single or double stranded, linear or super-coiled. The RNA-targeting complex of the invention has a wide variety of utility including modifying (e.g., deleting, inserting, translocating, inactivating, activating) a target RNA in a multiplicity of cell types. As such the RNA-targeting complex of the invention has a broad spectrum of applications in, e.g., gene therapy, drug screening, disease diagnosis, and prognosis. An exemplary RNA-targeting complex comprises a RNA-targeting effector protein complexed with a guide RNA or crRNA hybridized to a target sequence within the target locus of interest.

In one embodiment, this invention provides a method of cleaving a target RNA. The method may comprise modifying a target RNA using a RNA-targeting complex that binds to the target RNA and effect cleavage of said target RNA. In an embodiment, the RNA-targeting complex of the invention, when introduced into a cell, may create a break (e.g., a single or a double strand break) in the RNA sequence. For example, the method can be used to cleave a disease RNA in a cell. For example, an exogenous RNA template comprising a sequence to be integrated flanked by an upstream sequence and a downstream sequence may be introduced into a cell. The upstream and downstream sequences share sequence similarity with either side of the site of integration in the RNA. Where desired, a donor RNA can be mRNA. The exogenous RNA template comprises a sequence to be integrated (e.g., a mutated RNA). The sequence for integration may be a sequence endogenous or exogenous to the cell. Examples of a sequence to be integrated include RNA encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous RNA template are selected to promote recombination between the RNA sequence of interest and the donor RNA. The upstream sequence is a RNA sequence that shares sequence similarity with the RNA sequence upstream of the targeted site for integration. Similarly, the downstream sequence is a RNA sequence that shares sequence similarity with the RNA sequence downstream of the targeted site of integration. The upstream and downstream sequences in the exogenous RNA template can have 75%, 80%, 85%, 90%, 95%, or 100% sequence identity with the targeted RNA sequence. Preferably, the upstream and downstream sequences in the exogenous RNA template have about 95%, 96%, 97%, 98%, 99%, or 100% sequence identity with the targeted RNA sequence. In some methods, the upstream and downstream sequences in the exogenous RNA template have about 99% or 100% sequence identity with the targeted RNA sequence.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous RNA template may further comprise a marker. Such a marker may make it easy to screen for targeted integrations. Examples of suitable markers include restriction sites, fluorescent proteins, or selectable markers. The exogenous RNA template of the invention can be constructed using recombinant techniques (see, for example, Sambrook et al., 2001 and Ausubel et al., 1996). In a method for modifying a target RNA by integrating an exogenous RNA template, a break (e.g., double or single stranded break in double or single stranded RNA) is introduced into the RNA sequence by the nucleic acid-targeting complex, the break is repaired via homologous recombination with an exogenous RNA template such that the template is integrated into the RNA target. The presence of a double-stranded break facilitates integration of the template. In other embodiments, this invention provides a method of modifying expression of a RNA in a eukaryotic cell. The method comprises increasing or decreasing expression of a target polynucleotide by using a nucleic acid-targeting complex that binds to the DNA or RNA (e.g., mRNA or pre-mRNA). In some methods, a target RNA can be inactivated to effect the modification of the expression in a cell. For example, upon the binding of a RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA). Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissues compared with tissues or cells of a non disease control. It may be a RNA transcribed from a gene that becomes expressed at an abnormally high level; it may be a RNA transcribed from a gene that becomes expressed at an abnormally low level, where the altered expression correlates with the occurrence and/or progression of the disease. A disease-associated RNA also refers to a RNA transcribed from a gene possessing mutation(s) or genetic variation that is directly responsible or is in linkage disequilibrium with a gene(s) that is responsible for the etiology of a disease. The translated products may be known or unknown, and may be at a normal or abnormal level. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

In some embodiments, the method may comprise allowing a RNA-targeting complex to bind to the target RNA to effect cleavage of said target RNA thereby modifying the target RNA, wherein the RNA-targeting complex comprises a nucleic acid-targeting effector (Cas13b) protein complexed with a guide RNA or crRNA hybridized to a target sequence within said target RNA. In one aspect, the invention provides a method of modifying expression of RNA in a eukaryotic cell. In some embodiments, the method comprises allowing a RNA-targeting complex to bind to the RNA such that said binding results in increased or decreased expression of said RNA; wherein the RNA-targeting complex comprises a nucleic acid-targeting effector (Cas13b) protein complexed with a guide RNA. Methods of modifying a target RNA can be in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

The use of two different aptamers (each associated with a distinct RNA-targeting guide RNAs) allows an activator-adaptor protein fusion and a repressor-adaptor protein fusion to be used, with different RNA-targeting guide RNAs or crRNAs, to activate expression of RNA, whilst repressing another. They, along with their different guide RNAs or crRNAs can be administered together, or substantially together, in a multiplexed approach. A large number of such modified RNA-targeting guide RNAs or crRNAs can be used all at the same time, for example 10 or 20 or 30 and so forth, whilst only one (or at least a minimal number) of effector protein (Cas13b) molecules need to be delivered, as a comparatively small number of effector protein molecules can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the RNA-targeting effector protein-guide RNA complex as a whole may be associated with two or more functional domains. For example, there may be two or more functional domains associated with the RNA-targeting effector protein, or there may be two or more functional domains associated with the guide RNA or crRNA (via one or more adaptor proteins), or there may be one or more functional domains associated with the RNA-targeting effector protein and one or more functional domains associated with the guide RNA or crRNA (via one or more adaptor proteins).

The fusion between the adaptor protein and the activator or repressor may include a linker. For example, GlySer linkers GGGS can be used. They can be used in repeats of 3 ((GGGGS)$_3$) or 6, 9 or even 12 or more, to provide suitable lengths, as required. Linkers can be used between the guide RNAs and the functional domain (activator or repressor), or between the nucleic acid-targeting effector protein and the functional domain (activator or repressor). The linkers the user to engineer appropriate amounts of "mechanical flexibility".

Cas13b Effector Protein Complexes can Deliver Functional Effectors

Unlike CRISPR-Cas13b-mediated knockout, which eliminates expression by mutating at the RNA level, CRISPR-Cas13b knockdown allows for temporary reduction of gene expression through the use of artificial transcription factors, e.g., via mutating residues in cleavage domain(s) of the Cas13b protein results in the generation of a catalytically inactive Cas13b protein. A catalytically inactive Cas13b complexes with a guide RNA or crRNA and localizes to the RNA sequence specified by that guide RNA's or crRNA's targeting domain, however, it does not cleave the target. Fusion of the inactive Cas13b protein to an effector domain, e.g., a transcription repression domain, enables recruitment of the effector to any site specified by the guide RNA.

Optimized Functional RNA Targeting Systems

In an aspect the invention thus provides a system for specific delivery of functional components to the RNA environment. This can be ensured using the CRISPR systems comprising the RNA targeting effector proteins of the present invention (Table 1A or Table 1B Cas13b) which allow specific targeting of different components to RNA. More particularly such components include activators or repressors, such as activators or repressors of RNA translation, degradation, etc.

According to one aspect the invention provides non-naturally occurring or engineered composition comprising a guide RNA or crRNA comprising a guide sequence capable of hybridizing to a target sequence of interest in a cell, wherein the guide RNA or crRNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas13b complex having at least three functional domains, at least one of which is associated with the RNA targeting enzyme and at least two of which are associated with the gRNA or crRNA.

Delivery of the Cas13b Effector Protein Complex or Components Thereof

Through this disclosure and the knowledge in the art, TALEs, CRISPR-Cas systems, or components thereof or nucleic acid molecules thereof (including, for instance HDR template) or nucleic acid molecules encoding or providing components thereof may be delivered by a delivery system herein described both generally and in detail.

Vector delivery, e.g., plasmid, viral delivery: The CRISPR enzyme, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1 \times 10^5$ particles (also referred to as particle units, pu) of adenoviral vector. In an embodiment herein, the dose preferably is at least about $1 \times 10^6$ particles (for example, about $1 \times 10^6 - 1 \times 10^{12}$ particles), more preferably at least about $1 \times 10^7$ particles, more preferably at least about $1 \times 10^8$ particles (e.g., about $1 \times 10^8 - 1 \times 10^{11}$ particles or about $1 \times 10^8 - 1 \times 10^{12}$ particles), and most preferably at least about $1 \times 10^0$ particles (e.g., about $1 \times 10^9 - 1 \times 10^{10}$ particles or about $1 \times 10^9 - 1 \times 10^{12}$ particles), or even at least about $1 \times 10^{10}$ particles (e.g., about $1 \times 10^{10} - 1 \times 10^{12}$ particles) of the adenoviral vector. Alternatively, the dose comprises no more than about $1 \times 10^{14}$ particles, preferably no more than about $1 \times 10^{13}$ particles, even more preferably no more than about $1 \times 10^{12}$ particles, even more preferably no more than about $1 \times 10^{11}$ particles, and most preferably no more than about $1 \times 10^{10}$ particles (e.g., no more than about $1 \times 10^9$ articles). Thus, the dose may contain a single dose of adenoviral vector with, for example, about $1 \times 10^6$ particle units (pu), about $2 \times 10^6$ pu, about $4 \times 10^6$ pu, about $1 \times 10^7$ pu, about $2 \times 10^7$ pu, about $4 \times 10^7$ pu, about $1 \times 10^8$ pu, about $2 \times 10^8$ pu, about $4 \times 10^8$ pu, about $1 \times 10^9$ pu, about $2 \times 10^9$ pu, about $4 \times 10^9$ pu, about $1 \times 10^{10}$ pu, about $2 \times 10^{10}$ pu, about $4 \times 10^{10}$ pu, about $1 \times 10^{11}$ pu, about $2 \times 10^{11}$ pu, about $4 \times 10^{11}$ pu, about $1 \times 10^{12}$ pu, about $2 \times 10^{12}$ pu, or about $4 \times 10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1 \times 10^{10}$ to about $1 \times 10^{10}$ functional AAV/ml solution. The dosage may be adjusted to balance the therapeutic benefit against any side effects. In an embodiment herein, the AAV dose is generally in the range of concentrations of from about $1 \times 10^{5}$ to $1 \times 10^{50}$ genomes AAV, from about $1 \times 10^{8}$ to $1 \times 10^{20}$ genomes AAV, from about $1 \times 10^{10}$ to about $1 \times 10^{16}$ genomes, or about $1 \times 10^{11}$ to about $1 \times 10^{16}$ genomes AAV. A human dosage may be about $1 \times 10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 µg to about 10 µg per 70 kg individual. Plasmids of the invention will generally comprise (i) a promoter; (ii) a sequence encoding an nucleic acid-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver nucleic acid-targeting Cas protein and guide RNA (and, for instance, HR repair template) into cells using liposomes or particles. Thus delivery of the nucleic acid-targeting Cas13b protein and/or delivery of the guide RNAs or crRNAs of the invention may be in RNA form and via microvesicles, liposomes or particles. For example, Cas13b mRNA and guide RNA or crRNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (a-tocopherol) may be conjugated with nucleic acid-targeting Cas protein and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, Calif.) filled with phosphate-buffered saline (PBS) or free TocsiBACE or TocsiBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of nucleic acid-targeting effector protein conjugated to a-tocopherol and co-administered with HDL targeted to the brain may be contemplated for humans in the present invention, for example, about 3 nmol to about 3 µmol of nucleic acid-targeting effector protein targeted to the brain may be contemplated. Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 µl of a recombinant lentivirus having a titer of $1 \times 10^{9}$ transducing units (TU)/ml by an intrathecal catheter. A similar dosage of nucleic acid-targeting effector protein expressed in a lentiviral vector targeted to the brain may be contemplated for humans in the present invention, for example, about 10-50 ml of nucleic acid-targeting effector protein targeted to the brain in a lentivirus having a titer of $1 \times 10^{9}$ transducing units (TU)/ml may be contemplated.

In terms of local delivery to the brain, this can be achieved in various ways. For instance, material can be delivered intrastriatally e.g., by injection. Injection can be performed stereotactically via a craniotomy.

Packaging and Promoters Generally

Ways to package RNA-targeting effector protein (Cas13b proteins) coding nucleic acid molecules, e.g., DNA, into vectors, e.g., viral vectors, to mediate genome modification in vivo include:

Single Virus Vector:

Vector containing two or more expression cassettes:

Promoter-nucleic acid-targeting effector protein coding nucleic acid molecule-terminator Promoter-guide RNA1-terminator Promoter-guide RNA (N)-terminator (up to size limit of vector)

Double Virus Vector:

Vector 1 containing one expression cassette for driving the expression of RNA-targeting effector protein (Cas13b)

Promoter—RNA-targeting effector (Cas13b) protein coding nucleic acid molecule-terminator Vector 2 containing one more expression cassettes for driving the expression of one or more guide RNAs or crRNAs Promoter-guide RNA1 or crRNA1-terminator Promoter-guide RNA1 (N) or crRNA1 (N)-terminator (up to size limit of vector).

The promoter used to drive RNA-targeting effector protein coding nucleic acid molecule expression can include AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of nucleic acid-targeting effector protein. For ubiquitous expression, can use promoters: CMV, CAG, CBh, PGK, SV40, Ferritin heavy or light chains, etc. For brain or other CNS expression, can use promoters: SynapsinI for all neurons, CaMKIIalpha for excitatory neurons, GAD67 or GAD65 or VGAT for GABAergic neurons, etc. For liver expression, can use Albumin promoter. For lung expression, can use SP-B. For endothelial cells, can use ICAM. For hematopoietic cells can use IFNbeta or CD45. For Osteoblasts can use OG-2. The promoter used to drive guide RNA can include: Pol III promoters such as U6 or H1; Pol II promoter and intronic cassettes to express guide RNA or crRNA.

Adeno Associated Virus (AAV)

Cas13b and one or more guide RNA or crRNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of RNA-targeting effector protein (Cas13b effector protein) can be driven by a cell-type specific promoter. For example, liver-specific expression might use the Albumin promoter and neuron-specific expression (e.g., for targeting CNS disorders) might use the Synapsin I promoter. In terms of in vivo delivery, AAV is advantageous over other viral vectors for a couple of reasons: Low toxicity (this may be due to the purification method not requiring ultra centrifugation of cell particles that can activate the immune response) and Low probability of causing insertional mutagenesis because it doesn't integrate into the host genome.

AAV has a packaging limit of 4.5 or 4.75 Kb. This means that the RNA-targeting effector protein (Cas13b effector protein) coding sequence as well as a promoter and transcription terminator have to be all fit into the same viral vector. As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
| --- | --- | --- | --- | --- | --- | --- | --- | --- |
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |

-continued

| Cell Line | AAV-1 | AAV-2 | AAV-3 | AAV-4 | AAV-5 | AAV-6 | AAV-8 | AAV-9 |
|---|---|---|---|---|---|---|---|---|
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types. Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquoted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine inffectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the nucleic acid-targeting system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the nucleic acid-targeting system of the present invention. A minimum of $2.5 \times 10^6$ CD34+ cells per kilogram patient weight may be collected and prestimulated for 16 to 20 hours in X-VIVO 15 medium (Lonza) containing 2 μmon-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm' tissue culture flasks coated with fibronectin (25 mg/cm$^2$) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

RNA Delivery

RNA delivery: The nucleic acid-targeting Cas13b protein, and/or guide RNA, can also be delivered in the form of RNA. mRNA can be synthesized using a PCR cassette containing the following elements: T7_promoter-kozak sequence (GCCACC)-effector protein-3' UTR from beta globin-polyA tail (a string of 120 or more adenines). The cassette can be used for transcription by T7 polymerase. Guide RNAs or crRNAs can also be transcribed using in vitro transcription from a cassette containing T7_promoter-GG-guide RNA or crRNA sequence.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas13b system e.g., Cas13b enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof. See also Dahlman et al. "Orthogonal gene control with a catalytically active Cas9 nuclease," Nature Biotechnology 33, 1159-1161 (November, 2015).

Particles delivery systems within the scope of the present invention may be provided in any form, including but not limited to, solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

Cas13b mRNA and guide RNA or crRNA may be delivered simultaneously using particles or lipid envelopes; for instance, CRISPR enzyme and RNA of the invention, e.g., as a complex, can be delivered via a particle as in Dahlman et al., WO 2015/089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes). Cas13b effector protein mRNA and guide RNA may be delivered simultaneously using particles or lipid envelopes. This Dahlman et al technology can be applied in the instant invention. An epoxide-modified lipid-polymer may be utilized to deliver the nucleic acid-targeting system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg. For example, Su X, Fricke J, Kavanagh D G, Irvine DJ ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured particles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001.224:185-199). Doses of about 5 mg/kg are contemplated, with single or multiple doses, depending on the target tissue.

Regarding particles, see, also Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the nucleic acid-targeting system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition. US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell. US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the nucleic acid-targeting system of the present invention.

In another embodiment, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the nucleic acid-targeting system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated. LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding nucleic acid-targeting effector protein to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease. However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilinoleoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 1.1,g/ml of LNP or CRISPR-Cas RNA in or associated with the LNP may be contemplated, especially for a formulation containing DLinKC2-DMA.

Preparation of LNPs and CRISPR-Cas13b encapsulation may be used/and or adapted from Rosin et al, Molecular Therapy, vol. 19, no. 12, pages 1286-2200, December 2011). The cationic lipids 1,2-dilinoleoyl-3-dimethylammonium-propane (DLinDAP), 1,2-dilinoleyloxy-3-N,N-dimethyl-aminopropane (DLinDMA), 1,2-dilinoleyloxyketo-N,N-dimethyl-3-aminopropane (DLinK-DMA), 1,2-dilinoleyl-4-(2-dimethylaminoethyl)[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, Mo.). The specific nucleic acid-targeting complex (CRISPR-Cas) RNA may be encapsulated in LNPs containing DLinDAP, DLinDMA, DLinK-DMA, and DLinKC2-DMA (cationic lipid:DSPC:CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/1. This ethanol solution of lipid may be added drop-wise to 50 mmol/1 citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/1 citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Particle size distribution may be determined by dynamic light scattering using a NICOMP 370 particle sizer, the vesicle/intensity modes, and Gaussian fitting (Nicomp Particle Sizing, Santa Barbara, Calif.). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, Va.). In conjunction with the herein discussion of LNPs and PEG lipids, PEGylated liposomes or LNPs are likewise suitable for delivery of a nucleic acid-targeting system or components thereof. Preparation of large LNPs may be used/and or adapted from Rosin et al, Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/1, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at a RNA to total lipid ratio of approximately 1:10 (wt:wt), followed by incubation for 30 minutes at 37° C. to form loaded LNPs. The mixture may be subsequently dialyzed overnight in PBS and filtered with a 0.45-µm syringe filter.

Spherical Nucleic Acid (SNA™) constructs and other particles (particularly gold particles) are also contemplated as a means to delivery nucleic acid-targeting system to intended targets. Significant data show that AuraSense Therapeutics' Spherical Nucleic Acid (SNA™) constructs, based upon nucleic acid-functionalized gold particles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of nucleic acid-targeting complex RNA is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHSester) was ordered from Macrocyclics (Dallas, Tex.). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNA sense conjugate was ethanol-precipitated, resuspended in water, and annealed to the unmodified antisense strand to yield DOTA-siRNA. All liquids were pretreated with Chelex-100 (Bio-Rad, Hercules, Calif.) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts a RNA clinical trial that uses a targeted particle-delivery system (clinical trial registration number NCT00689065). Patients with solid cancers refractory to standard-of-care therapies are administered doses of targeted particles on days 1, 3, 8 and 10 of a 21-day cycle by a 30-min intravenous infusion. The particles comprise, consist essentially of, or consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m$^{-2}$ siRNA, respectively. Similar doses may also be contemplated for the nucleic acid-targeting system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

In terms of this invention, it is preferred to have one or more components of RNA-targeting complex, e.g., nucleic acid-targeting effector (Cas13b) protein or mRNA therefor, or guide RNA or crRNA delivered using particles or lipid envelopes. Other delivery systems or vectors are may be used in conjunction with the particle aspects of the invention. Particles encompassed in the present invention may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured, and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid. U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material. U.S. Pat. No. 5,855,913, incorporated herein by reference, provides a particulate composition having aerodynamically light particles having a tap density of less than 0.4 g/cm3 with a mean diameter of between 5 μm and 30 μm, incorporating a surfactant on the surface thereof for drug delivery to the pulmonary system. U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system. U.S. Pat. No. 5,543,158, incorporated herein by reference, provides biodegradable injectable particles having a biodegradable solid core containing a biologically active material and poly(alkylene glycol) moieties on the surface. WO 2012/135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such methods and materials of herein-cited documents, e.g., conjugated lipomers can be used in the context of the nucleic acid-targeting system to achieve in vitro, ex vivo and in vivo genomic perturbations to modify gene expression, including modulation of protein expression.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 µg of exosomes (measured based on protein concentration) per $10^6$ cells. Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 µF resulted in the greatest retention of RNA and was used for all subsequent experiments. Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or −] 15%, P<0.001 and 61% [+ or −] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the β-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA. Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the nucleic acid-targeting system of the present invention to therapeutic targets, especially neurodegenerative diseases. A dosage of about 100 to 1000 mg of nucleic acid-targeting system encapsulated in about 100 to 1000 mg of RVG exosomes may be contemplated for the present invention.

El-Andaloussi et al. (Nature Protocols 7,2112-2126 (2012)) provides exosomes derived from cultured cells harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention. Exosomes from plasma can be prepared by centrifugation of buffy coat at 900 g for 20 min to isolate the plasma followed by harvesting cell supernatants, centrifuging at 300 g for 10 min to eliminate cells and at 16500×g for 30 min followed by filtration through a 0.22 mm filter. Exosomes are pelleted by ultracentrifugation at 120000×g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of nucleic acid-targeting system into exosomes may be conducted similarly to siRNA. The exosomes may be co-cultured with monocytes and lymphocytes isolated from the peripheral blood of healthy donors. Therefore, it may be contemplated that exosomes containing nucleic acid-targeting system may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review). Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review). A liposome formulation may be mainly comprised of natural phospholipids and lipids such as 1,2-distearoyl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review). In a particularly advantageous embodiment, Trojan Horse liposomes (also known as Molecular Trojan Horses) are desirable and protocols may be found at http://cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR-Cas13b complexes to the brain via an intravascular injection, which would allow whole brain transgenic animals without the need for embryonic manipulation. About 1-5 g of DNA or RNA may be contemplated for in vivo administration in liposomes.

In another embodiment, the nucleic acid-targeting system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific nucleic acid-targeting system targeted in a SNALP are contemplated. The daily treatment may be over about three days and then weekly for about five weeks. In another embodiment, a specific nucleic acid-targeting system encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(methoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006). In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size. In yet another embodiment, a SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(w-methoxy poly(ethylene glycol)2000) carbamoyl]-1,2-dimyrestyloxypropylamine, and cationic 1,2-dilinoleyloxy-3-N,N-dimethylaminopropane (see, e.g., Geisbert et al., Lancet 2010; 375: 1896-905). A dosage of about 2 mg/kg total nucleic acid-targeting systemper dose administered as, for example, a bolus intravenous infusion may be contemplated. In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N; N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties. To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial. Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC)—both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Biotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM $Na_2HPO_4$, 1 mM $KH_2PO_4$, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 μm filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the nucleic acid-targeting system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate nucleic acid-targeting system or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, di stearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11±0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the RNA-targeting system (CRISPR-Cas13b complex, i.e., the Cas13b complexed with crRNA) of the present invention or component(s) thereof or nucleic acid molecule(s) coding therefor to form lipid nanoparticles (LNPs). Lipids include, but are not limited to, DLin-KC2-DMA4, C12-200 and colipids distearoylphosphatidyl choline, cholesterol, and PEG-DMG may be formulated with RNA-targeting system instead of siRNA (see, e.g., Novobrantseva, Molecular Therapy—Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/di stearoylphosphatidyl choline/cholesterol/PEG-DMG). The final lipid:siRNA weight ratio may be ~12:1 and 9:1 in the case of DLin-KC2-DMA and C12-200 lipid particles (LNPs), respectively. The formulations may have mean particle diameters of ~80 nm with >90% entrapment efficiency. A 3 mg/kg dose may be contemplated. Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The RNA-targeting system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N-P(O$_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied. US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of nucleic acid-targeting-system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of nucleic acid-targetingsystem(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA should be performed to optimize the procedure for specific cell lines. (1) One day before treatment, plate 1×10$^5$ cells per well in a 48-well plate. (2) On the day of treatment, dilute purified +36 GFP protein in serum free media to a final concentration 200 nM. Add RNA to a final concentration of 50 nM. Vortex to mix and incubate at room temperature for 10 min. (3) During incubation, aspirate media from cells and wash once with PBS. (4) Following incubation of +36 GFP and RNA, add the protein-RNA complexes to cells. (5) Incubate cells with complexes at 37° C. for 4h. (6) Following incubation, aspirate the media and wash three times with 20 U/mL heparin PBS. Incubate cells with serum-containing media for a further 48 h or longer depending upon the assay for activity. (7) Analyze cells by immunoblot, qPCR, phenotypic assay, or other appropriate method.

+36 GFP was found to be an effective plasmid delivery reagent in a range of cells. See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319

(2012); Thompson, D. B., et al., Chemistry & Biology 19 (7), 831-843 (2012). The methods of the super charged proteins may be used and/or adapted for delivery of the RNA-targeting system(s) or component(s) thereof or nucleic acid molecule(s) coding therefor of the invention.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intraarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions. The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections. CPP delivery can be used in the practice of the invention.

Implantable Devices

In another embodiment, implantable devices are also contemplated for delivery of the RNA-targeting system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used/and or adapted to the nucleic acid-targeting system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure. US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123. The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 m$^3$ to 1000 mm$^3$, as required by the volume for the agent load. The Loder may optionally be larger, for example when incorporated with a device whose size is determined by functionality, for example and without limitation, a knee joint, an intra-uterine or cervical ring and the like. The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period. The drug delivery system optionally and preferably is designed to shield the nucleotide based therapeutic agent from degradation, whether chemical in nature or due to attack from enzymes and other factors in the body of the subject. The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices. According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle. The site for implantation of the composition, or target site, preferably features a radius, area and/or volume that is sufficiently small for targeted local delivery. For example, the target site optionally has a diameter in a range of from about 0.1 mm to about 5 cm. The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof. For example the composition (optionally with the device) is optionally implanted within or in the proximity to pancreas, prostate, breast, liver, via the nipple, within the vascular system and so forth. The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear—auditory system, labyrinth of the inner ear, vestibular system; 11. Intra tracheal; 12. Intra-cardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site. Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to embodiments of US Patent Publication 20110195123 that can be used in the practice of the invention, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the nucleic acid-targeting system of the present invention. As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately.

All of this may be used and/or adapted to the RNA-targeting system of the present invention. Implantable device technology herein discussed can be employed with herein teachings and hence by this disclosure and the knowledge in the art, CRISPR-Cas13b system or complex or components thereof or nucleic acid molecules thereof or encoding or providing components may be delivered via an implantable device.

Patient-Specific Screening Methods

A nucleic acid-targeting system that targets RNA can be used to screen patients or patient samples for the presence of particular RNA.

CRISPR Effector Protein mRNA and Guide RNA

CRISPR effector (Cas13b) protein or mRNA therefor (or more generally a nucleuic acid molecule therefor) and guide RNA or crRNA might also be delivered separately e.g., the former 1-12 hours (preferably around 2-6 hours) prior to the administration of guide RNA or crRNA, or together. A second booster dose of guide RNA or crRNA can be administered 1-12 hours (preferably around 2-6 hours) after the initial administration.

The Cas13b effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA or RNA binding, but not necessarily cutting or nicking, activity, including a dead-Cas effector protein function.

Cellular targets include Hemopoietic Stem/Progenitor Cells (CD34+); Human T cells; and Eye (retinal cells)—for example photoreceptor precursor cells.

Inventive methods can further comprise delivery of templates. Delivery of templates may be via the cotemporaneous or separate from delivery of any or all the CRISPR effector protein (Cas13b) or guide or crRNA and via the same delivery mechanism or different. Inducible Systems In some embodiments, a CRISPR effector (Cas 13n) protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, and WO 2014/018423 A2 which is hereby incorporated by reference in its entirety.

Self-Inactivating Systems

Once all copies of RNA in a cell have been edited, continued a Cas13b effector protein expression or activity in that cell is no longer necessary. A Self-Inactivating system that relies on the use of RNA as to the Cas13b or crRNA as the guide target sequence can shut down the system by preventing expression of Cas13b or complex formation.

Kits

In one aspect, the invention provides kits containing any one or more of the elements disclosed in the above methods and compositions. In some embodiments, the kit comprises a vector system as taught herein or one or more of the components of the CRISPR/Cas13b system or complex as taught herein, such as crRNAs and/or Cas13b effector protein or Cas13b effector protein encoding mRNA, and instructions for using the kit. Elements may be provide individually or in combinations, and may be provided in any suitable container, such as a vial, a bottle, or a tube. In some embodiments, the kit includes instructions in one or more languages, for example in more than one language. The instructions may be specific to the applications and methods described herein. In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g., in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide or crRNA sequence and a regulatory element. In some embodiments, the kit comprises a homologous recombination template polynucleotide. In some embodiments, the kit comprises one or more of the vectors and/or one or more of the polynucleotides described herein. The kit may advantageously allows to provide all elements of the systems of the invention.

The invention has a broad spectrum of applications in, e.g., gene therapy, drug screening, disease diagnosis, and prognosis.

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogsteen binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 *Nuc. Acids Research* 12 p 387). Examples of other software than may perform sequence comparisons include, but are not limited to, the BLAST package (see Ausubel et al., 1999 *Short Protocols in Molecular Biology*, 4th Ed.—Chapter 18), FASTA (Altschul et al., 1990 *J Mol. Biol.* 403-410) and the GENEWORKS suite of comparison tools. Both BLAST and FASTA are available for offline and online searching (see Ausubel et al., 1999, *Short Protocols in Molecular Biology, pages* 7-58 to 7-60). However, for some applications, it is preferred to use the GCG Bestfit program. A new tool, called BLAST 2 Sequences is also available for comparing protein and nucleotide sequences (see *FEMS Microbiol Lett.* 1999 174 (2): 247-50; *FEMS Microbiol Lett.* 1999 177(1): 187-8 and the web site of the National Center for Biotechnology information at the web site of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), *Gene* 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" *Comput. Appl. Biosci.* 9: 745-756) (Taylor W. R. (1986) "The classification of amino acid conservation" *J. Theor. Biol.* 119; 205-218). Conservative substitutions (also with reference to discussion of same herein in conjunction with Table 1A or Table 1B) may be made, for example according to the table below which describes a generally accepted Venn diagram grouping of amino acids.

| | Set | | Sub-set |
|---|---|---|---|
| Hydrophobic | F W Y H K M I L V A G (SEQ ID NO: 17) | C Aromatic | F W Y H (SEQ ID NO: 20) |
| | | Aliphatic | I L V |
| Polar | W Y H K R E D C S T N (SEQ ID NO: 18) | Q Charged | H K R E D (SEQ ID NO: 21) |
| | | Positively charged | H K R |
| | | Negatively charged | E D |
| Small | V C A G S P T N D (SEQ ID NO: 19) | Tiny | A G S |

The citations herein concerning conservative substitutions in conjunction with Table 1A or Table 1B are also mentioned to refer to same as to conservative substitutions.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition. As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested. The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)). Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif (1990). Alternatively, the recombinant expression vector can be transcribed and translated in vitro, for example using T7 promoter regulatory sequences and T7 polymerase. Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyridylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., PNAS (1992) 89(20), 9367-9371 and Horwell D C, Trends Biotechnol. (1995) 13(4), 132-134. Homology modelling: Corresponding residues in other Cas13b orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR. In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids. Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety. Aspects of the invention relate to bicistronic vectors for guide RNA and wild type, modified or mutated CRISPR effector proteins/enzymes (e.g. Cas13b effector proteins). Bicistronic expression vectors guide RNA and wild type, modified or mutated CRISPR effector proteins/enzymes (e.g. Cas13b effector proteins) are preferred. In general and particularly in this embodiment and wild type, modified or mutated CRISPR effector proteins/enzymes (e.g. Cas13b effector proteins) is preferably driven by the CBh promoter. The RNA may preferably be driven by a Pol III promoter, such as a U6 promoter. Ideally the two are combined.

In some embodiments, a loop in the guide RNA or crRNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89). In some embodiments, a vector is a yeast expression vector. Examples of vectors for expression in yeast *Saccharomyces cerevisiae* include pYepSec1 (Baldari, et al., 1987. EMBO 1 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif.), and picZ (InVitrogen Corp, San Diego, Calif). In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39). In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989. In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO* 1 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the a-fetoprotein promoter (Campes and Tilghman, 1989. *Genes Dev.* 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

In some embodiments, a regulatory element is operably linked to one or more elements of or encoding a CRISPR Cas13b system or complex so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, *Pyrobaculum, Sulfolobus, Archaeoglobus, Haloarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azoarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga*.

In general, "RNA-targeting system" as used in the present application refers collectively to transcripts and other elements involved in the expression of or directing the activity of RNA-targeting CRISPR-associated 13b ("Cas13b") genes (also referred to herein as an effector protein), including sequences encoding a RNA-targeting Cas (effector) protein and a guide RNA (or crRNA sequence), with reference to Table 1A or Table 1B as herein discussed. In general, a RNA-targeting system is characterized by elements that promote the formation of a RNA-targeting complex at the site of a target sequence. In the context of formation of a RNA-targeting complex, "target sequence" refers to a RNA sequence to which a guide sequence (or the guide or of the crRNA) is designed to have complementarity, where hybridization between a target sequence and a guide RNA promotes the formation of a RNA-targeting complex. Full complementarity is not necessarily required, provided there is sufficient complementarity to cause hybridization and promote formation of a RNA-targeting complex. In some embodiments, a target sequence is located in the nucleus or cytoplasm of a cell. In some embodiments, the target sequence may be within an organelle of a eukaryotic cell. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination. In general, a guide sequence is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a RNA-targeting complex to a target sequence may be assessed by any suitable assay. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence. In some embodiments, the RNA-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR Cas13b effector protein/enzyme is part of a fusion protein comprising one or more heterologous protein domains (e.g. about or more than about 1, 2, 3, 4, 5, 6, 7, 8, 9, 10, or more domains in addition to the CRISPR Cas13b enzyme). Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A nucleic acid-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a nucleic acid-targeting effector protein are described in US20110059502, incorporated herein by reference. In some embodiments, a tagged nucleic acid-targeting effector protein is used to identify the location of a target sequence. In some embodiments, a CRISPR Cas13b enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy.

Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR Cas13b enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO 2014/093635, which is hereby incorporated by reference in its entirety. In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a RNA-targeting effector protein in combination with (and optionally complexed with) a guide RNA or crRNA is delivered to a cell. Conventional viral and non-viral based gene transfer methods can be used to introduce nucleic acids in mammalian cells or target tissues. Such methods can be used to administer nucleic acids encoding components of a RNA-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Böhm (eds) (1995); and Yu et al., Gene Therapy 1:13-26 (1994). Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

Models of Conditions

A method of the invention may be used to create a plant, an animal or cell that may be used to model and/or study genetic or epigenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal or cell in which expression of one or more nucleic acid sequences associated with a disease are altered. Such a nucleic acid sequence may encode or be translated a disease associated protein sequence or may be a disease associated control sequence. Accordingly, it is understood that in embodiments of the invention, a plant, subject, patient, organism or cell can be a non-human subject, patient, organism or cell. Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged. In some methods, the disease model can be used to study the effects of mutations, or more general altered, such as reduced, expression of genes or gene products on the animal or cell and development and/or progression of the disease using measures commonly used in the study of the disease. Alternatively, such a disease model is useful for studying the effect of a pharmaceutically active compound on the disease. In some methods, the disease model can be used to assess the efficacy of a potential gene therapy strategy. That is, a disease-associated RNA can be modified such that the disease development and/or progression is displayed or inhibited or reduced and then effects of a compound on the progression or inhibition or reduction are tested.

Useful in the practice of the instant invention utilizing Table 1A or Table 1B Cas13b effector proteins and complexes thereof and nucleic acid molecules encoding same and methods using same, reference is made to: Genome-Scale CRISPR-Cas9 Knockout Screening in Human Cells. Shalem, O., Sanjana, N E., Hartenian, E., Shi, X., Scott, DA., Mikkelson, T., Heckl, D., Ebert, B L., Root, D E., Doench, J G., Zhang, F. Science December 12. (2013). [Epub ahead of print]; Published in final edited form as: Science. 2014 Jan. 3; 343(6166): 84-87. Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hitsNF2, CUL3, TADA2B, and TADA1. The authors observed a high level of consistency between independent guide RNAs targeting the same gene and a high rate of hit confirmation, and thus demonstrated the promise of genome-scale screening with Cas9. Reference is also made to US patent publication number US20140357530; and PCT Patent Publication WO 2014/093701, hereby incorporated herein by reference.

The term "associated with" is used here in relation to the association of the functional domain to the Cas13b effector protein or the adaptor protein. It is used in respect of how one molecule 'associates' with respect to another, for example between an adaptor protein and a functional domain, or between the Cas13b effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the Cas13b effector protein or adaptor protein is associated with a functional domain by binding thereto. In other embodiments, the Cas13b effector protein or adaptor protein is associated with a functional domain because the two are fused together, optionally via an intermediate linker.

Cas13b Effector Protein Complexes can be Used in Plants

The invention in some embodiments comprehends a method of modifying an cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced. The system may comprise one or more different vectors. In an aspect of the invention, the effector protein is codon optimized for expression the desired cell type, preferentially a eukaryotic cell, preferably a mammalian cell or a human cell. Cas13b system(s) (e.g., single or multiplexed) can be used in conjunction with recent advances in crop genomics. Such CRISPR system(s) can be used to perform efficient and cost effective plant gene or genome or transcriptome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. Such CRISPR system(s) can be used with regard to plants in Site-Directed Integration (SDI) or Gene Editing (GE) or any Near Reverse Breeding (NRB) or Reverse Breeding (RB) techniques. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein. Engineered plants modified by the effector protein (Table 1A or Table 1B Cas13b) and suitable guide (crRNA), and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide. Any aspect of using classical CRISPR-Cas systems may be adapted to use in CRISPR systems that are Cas protein agnostic, e.g. Cas13b effector protein systems.

Therapeutic Treatment

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations). Expression of the toxic RNA may be associated with formation of nuclear inclusions and late-onset degenerative changes in brain, heart or skeletal muscle. In the best studied example, myotonic dystrophy, it appears that the main pathogenic effect of the toxic RNA is to sequester binding proteins and compromise the regulation of alternative splicing (Hum. Mol. Genet. (2006) 15 (suppl 2): R162-R169). Myotonic dystrophy [dystrophia myotonica (DM)] is of particular interest to geneticists because it produces an extremely wide range of clinical features. A partial listing would include muscle wasting, cataracts, insulin resistance, testicular atrophy, slowing of cardiac conduction, cutaneous tumors and effects on cognition. The classical form of DM, which is now called DM type 1 (DM1), is caused by an expansion of CTG repeats in the 3'-untranslated region (UTR) of DMPK, a gene encoding a cytosolic protein kinase.

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs. The RNA targeting effector protein (Table 1A or Table 1B Cas13b) of the invention can further be used for antiviral activity, in particular against RNA viruses. The effector protein (Table 1A or Table 1B Cas13b) can be targeted to the viral RNA using a suitable guide RNA selective for a selected viral RNA sequence. In particular, the effector protein may be an active nuclease that cleaves RNA, such as single stranded RNA. Therapeutic dosages of the enzyme system of the present invention to target RNA the above-referenced RNAs are contemplated to be about 0.1 to about 2 mg/kg the dosages may be administered sequentially with a monitored response, and repeated dosages if necessary, up to about 7 to 10 doses per patient. Advantageously, samples are collected from each patient during the treatment regimen to ascertain the effectiveness of treatment. For example, RNA samples may be isolated and quantified to determine if expression is reduced or ameliorated. Such a diagnostic is within the purview of one of skill in the art.

Transcript Detection Methods

The effector proteins (Table 1A or Table 1B Cas13b) and systems of the invention are useful for specific detection of RNAs in a cell or other sample. In the presence of an RNA target of interest, guide-dependent Cas13b nuclease activity may be accompanied by non-specific RNAse activity against collateral targets. To take advantage of the RNase activity, all that is needed is a reporter substrate that can be detectably cleaved. For example, a reporter molecule can comprise RNA, tagged with a fluorescent reporter molecule (fluor) on one end and a quencher on the other. In the absence of Cas13b RNase activity, the physical proximity of the quencher dampens fluorescence from the fluor to low levels. When Cas13b target specific cleavage is activated by the presence of an RNA target-of-interest and suitable guide RNA, the RNA-containing reporter molecule is non-specifically cleaved and the fluor and quencher are spatially separated. This causes the fluor to emit a detectable signal when excited by light of the appropriate wavelength. In one exemplary assay method, Cas13b effector, target-of-interest-specific guide RNA, and reporter molecule are added to a cellular sample. An increase in fluorescence indicates the presence of the RNA target-of-interest. In another exemplary method, a detection array is provided. Each location of the array is provided with Cas13b effector, reporter molecule, and a target-of-interest-specific guide RNA. Depending on the assay to be performed, the target-of-interest-specific guide RNAs at each location of the array can be the same, different, or a combination thereof. Different target-of-interest-specific guide RNAs might be provided, for example when it is desired to test for one or more targets in a single source sample. The same target-of-interest-specific guide RNA might be provided at each location, for example when it is desired to test multiple samples for the same target.

In certain embodiments, Cas13b is provided or expressed in an in vitro system or in a cell, transiently or stably, and targeted or triggered to non-specifically cleave cellular nucleic acids. In one embodiment, Cas13b is engineered to knock down ssDNA, for example viral ssDNA. In another embodiment, Cas13b is engineered to knock down RNA. The system can be devised such that the knockdown is dependent on a target DNA present in the cell or in vitro system, or triggered by the addition of a target nucleic acid to the system or cell.

In an embodiment, the Cas13b system is engineered to non-specifically cleave RNA in a subset of cells distinguishable by the presence of an aberrant DNA sequence, for instance where cleavage of the aberrant DNA might be incomplete or ineffectual. In one non-limiting example, a DNA translocation that is present in a cancer cell and drives cell transformation is targeted. Whereas a subpopulation of cells that undergoes chromosomal DNA and repair may survive, non-specific collateral ribonuclease activity advantageously leads to cell death of potential survivors.

Collateral activity was recently leveraged for a highly sensitive and specific nucleic acid detection platform termed SHERLOCK that is useful for many clinical diagnoses (Gootenberg, J. S. et al. Nucleic acid detection with CRISPR-Cas13a/C2c2. Science 356, 438-442 (2017)).

According to the invention, engineered Cas13b systems are optimized for RNA endonuclease activity and can be expressed in mammalian cells and targeted to effectively knock down reporter molecules or transcripts in cells.

The collateral effect of engineered Cas13b with isothermal amplification provides a CRISPR-based diagnostic providing rapid DNA or RNA detection with high sensitivity and single-base mismatch specificity. The Cas13b-based molecular detection platform is used to detect specific strains of virus, distinguish pathogenic bacteria, genotype human DNA, and identify cell-free tumor DNA mutations. Furthermore, reaction reagents can be lyophilized for cold-chain independence and long-term storage, and readily reconstituted on paper for field applications.

The ability to rapidly detect nucleic acids with high sensitivity and single-base specificity on a portable platform may aid in disease diagnosis and monitoring, epidemiology, and general laboratory tasks. Although methods exist for detecting nucleic acids, they have trade-offs among sensitivity, specificity, simplicity, cost, and speed.

Microbial Clustered Regularly Interspaced Short Palindromic Repeats (CRISPR) and CRISPR-associated (CRISPR-Cas) adaptive immune systems contain programmable endonucleases that can be leveraged for CRISPR-based diagnostics (CRISPR-Dx). Cas13b can be reprogrammed with CRISPR RNAs (crRNAs) to provide a platform for specific DNA sensing. Upon recognition of its DNA target, activated Cas13b engages in "collateral" cleavage of nearby non-targeted nucleic acids (i.e., RNA and/or ssDNA). This crRNA-programmed collateral cleavage activity allows Cas13b to detect the presence of a specific DNA in vivo by triggering programmed cell death or by nonspecific degradation of labeled RNA or ssDNA. Here is described an in vitro nucleic acid detection platform with high sensitivity based on nucleic acid amplification and Cas13b-mediated collateral cleavage of a commercial reporter RNA, allowing for real-time detection of the target.

In certain example embodiments, the Cas13b effector protein is from an organism identified in Table 1A or Table 1B. In certain example embodiments, the Cas13b effector protein is from an organism selected from *Bergeyella zoohelcum, Prevotella intermedia, Prevotella buccae, Porphyromonas gingivalis, Bacteroides pyogenes, Alistipes* sp. ZOR0009, *Prevotella* sp. MA2016, *Riemerella anatipestifer, Prevotella aurantiaca, Prevotella saccharolytica, Myroides odoratimimus* CCUG 10230, *Capnocytophaga canimorsus, Porphyromonas gulae, Prevotella* sp. P5-125, *Flavobacterium branchiophilum, Myroides odoratimimus, Flavobacterium columnare,* or *Porphyromonas* sp. COT-052 OH4946. In another embodiment, the one or more guide RNAs are designed to bind to one or more target RNA sequences that are diagnostic for a disease state.

In certain example embodiments, an RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed.

In another example embodiment, the RNA-based masking construct is a ribozyme that generates a negative detectable signal, and wherein the positive detectable signal is generated when the ribozyme is deactivated. In one example embodiment, the ribozyme converts a substrate to a first color and wherein the substrate converts to a second color when the ribozyme is deactivated. In another example embodiment, the RNA-based masking agent is an aptamer that sequesters an enzyme, wherein the enzyme generates a detectable signal upon release from the aptamer by acting upon a substrate, or the aptamer sequesters a pair of agents that when released from the aptamers combine to generate a detectable signal.

In another example embodiment, the RNA-based masking construct comprises an RNA oligonucleotide to which are attached a detectable ligand oligonucleotide and a masking component. In certain example embodiments, the detectable ligand is a fluorophore and the masking component is a quencher molecule.

In another aspect, the invention provides a method for detecting target RNAs in samples, comprising: distributing a sample or set of samples into one or more individual discrete volumes, the individual discrete volumes comprising a CRISPR system comprising an effector protein, one or more guide RNAs, an RNA-based masking construct; incubating the sample or set of samples under conditions sufficient to allow binding of the one or more guide RNAs to one or more target molecules; activating the CRISPR effector protein via binding of the one or more guide RNAs to the one or more target molecules, wherein activating the CRISPR effector protein results in modification of the RNA-based masking construct such that a detectable positive signal is produced; and detecting the detectable positive signal, wherein detection of the detectable positive signal indicates a presence of one or more target molecules in the sample.

In another aspect, the invention provides a method for detecting peptides in samples, comprising: distributing a sample or set of samples into a set of individual discrete volumes, the individual discrete volumes comprising peptide detection aptamers, a CRISPR system comprising an effector protein, one or more guide RNAs, an RNA-based masking construct, wherein the peptide detection aptamers comprising a masked RNA polymerase site and configured to bind one or more target molecules; incubating the sample or set of samples under conditions sufficient to allow binding of the peptide detection aptamers to the one or more target molecules, wherein binding of the aptamer to a corresponding target molecule exposes the RNA polymerase binding site resulting in RNA synthesis of a trigger RNA; activating the CRISPR effector protein via binding of the one or more guide RNAs to the trigger RNA, wherein activating the CRISPR effector protein results in modification of the RNA-based masking construct such that a detectable positive signal is produced; and detecting the detectable positive signal, wherein detection of the detectable positive signal indicates a presence of one or more target molecules in a sample.

In certain example embodiments, the one or more guide RNAs are designed to bind to one or more target molecules that are diagnostic for a disease state. In certain other example embodiments, the disease state is an infection, an organ disease, a blood disease, an immune system disease, a cancer, a brain and nervous system disease, an endocrine disease, a pregnancy or childbirth-related disease, an inherited disease, or an environmentally-acquired disease, cancer, or a fungal infection, a bacterial infection, a parasite infection, or a viral infection.

In certain example embodiments, the RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed, or the RNA-based masking construct is a ribozyme that generates the negative detectable signal, and wherein the positive detectable signal is generated when the ribozyme is inactivated. In other example embodiments, the ribozyme converts a substrate to a first state and wherein the substrate converts to a second state when the ribozyme is inactivated, or the RNA-based masking agent is an aptamer, or the aptamer sequesters an enzyme, wherein the enzyme generates a detectable signal upon release from the aptamer by acting upon a substrate, or the aptamer sequesters a pair of agents that when released from the aptamers combine to generate a detectable signal. In still further embodiments, the RNA-based masking construct comprises an RNA oligonucleotide with a detectable ligand on a first end of the RNA oligonucleotide and a masking component on a second end of the RNA oligonucleotide, or the detectable ligand is a fluorophore and the masking component is a quencher molecule.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US 2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents EP 2 784 162 B1 and EP 2 771 468 B1; European Patent Applications EP 2 771 468 (EP13818570.7), EP 2 764 103 (EP13824232.6), and EP 2 784 162 (EP14170383.5); and PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809). Reference is also made to U.S. provisional patent applications 61/758,468; 61/802,174; 61/806,375; 61/814, 263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014 6/10/14; PCT/US2014/041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15,2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915, 260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013.

Mention is also made of U.S. application 62/091,455, filed, 12-Dec.-14, PROTECTED GUIDE RNAS (PGRNAS); U.S. application 62/096,708, 24-Dec.-14, PROTECTED GUIDE RNAS (PGRNAS); U.S. application 62/091,462, 12-Dec.-14, DEAD GUIDES FOR CRISPR TRANSCRIPTION FACTORS; U.S. application 62/096,324, 23-Dec.-14, DEAD GUIDES FOR CRISPR TRANSCRIPTION FACTORS; U.S. application 62/091,456, 12-Dec.-14, ESCORTED AND FUNCTIONALIZED GUIDES FOR CRISPR-CAS SYSTEMS; U.S. application 62/091,461, 12-Dec.-14, DELIVERY, USE AND THERAPEUTIC APPLICATIONS OF THE CRISPR-CAS SYSTEMS AND COMPOSITIONS FOR GENOME EDITING AS TO HEMATOPOIETIC STEM CELLS (HSCs); U.S. application 62/094,903, 19-Dec.-14, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24-Dec.-14, ENGINEERING OF SYSTEMS, METHODS AND OPTIMIZED ENZYME AND GUIDE SCAFFOLDS FOR SEQUENCE MANIPULATION; U.S. application 62/098,059, 30-Dec.-14, RNA-TARGETING SYSTEM; U.S. application 62/096,656, 24-Dec.-14, CRISPR HAVING OR ASSOCIATED WITH DESTABILIZATION DOMAINS; U.S. application 62/096,697, 24-Dec.-14, CRISPR HAVING OR ASSOCIATED WITH AAV; U.S. application 62/098,158, 30-Dec.-14, ENGINEERED CRISPR COMPLEX INSERTIONAL TARGETING SYSTEMS; U.S. application 62/151,052, 22-Apr.-15, CELLULAR TARGETING FOR EXTRACELLULAR EXOSOMAL REPORTING; U.S. application 62/054,490, 24-Sep.-14, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 62/055,484, 25-Sep.-14, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4-Dec.-14, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24-Sep.-14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23-Oct.-14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24-Sep.-14, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24-Sep.-14, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25-Sep.-14, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25-Sep.-14, MULTIFUNCTIONAL-CRISPR COMPLEXES AND/OR OPTIMIZED ENZYME LINKED FUNCTIONAL-CRISPR COMPLEXES; U.S. application 62/087,475, 4-Dec.-14, FUNCTIONAL SCREENING WITH OPTIMIZED FUNCTIONAL CRISPR-CAS SYSTEMS; U.S. application 62/055,487, 25-Sep.-14, FUNCTIONAL SCREENING WITH OPTIMIZED FUNCTIONAL CRISPR-CAS SYSTEMS; U.S. application 62/087,546, 4-Dec.-14, MULTIFUNCTIONAL CRISPR COMPLEXES AND/OR OPTIMIZED ENZYME LINKED FUNCTIONAL-CRISPR COMPLEXES; and U.S. application 62/098,285, 30-Dec.-14, CRISPR MEDIATED IN VIVO MODELING AND GENETIC SCREENING OF TUMOR GROWTH AND METASTASIS.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121): 819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4):910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463):472-6. doi: 10.1038/Nature12466. Epub 2013 August 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print];

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure™, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014 (2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh 00, Barcena C, Hsu P D, Habib N, Gootenberg J S, Nishimasu H, Nureki O, Zhang F., Nature. January 29; 517(7536):583-8 (2015).

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520 (7546):186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015).

Nishimasu et al., Crystal Structure of *Staphylococcus aureus* Cas9," Cell 162, 1113-1126
(Aug. 27, 2015).

Zetsche et al. (2015), "Cpf1 is a single RNA-guided endonuclease of a class 2 CRISPR-Cas system," Cell 163, 759-771 (Oct. 22, 2015) doi: 10.1016/j.cell.2015.09.038. Epub Sep. 25, 2015.

Shmakov et al. (2015), "Discovery and Functional Characterization of Diverse Class 2 CRISPR-Cas Systems," Molecular Cell 60, 385-397 (Nov. 5, 2015) doi: 10.1016/j.molce1.2015.10.008. Epub Oct. 22, 2015.

Dahlman et al., "Orthogonal gene control with a catalytically active Cas9 nuclease," Nature
Biotechnology 33, 1159-1161 (November, 2015).

Gao et al, "Engineered Cpf1 Enzymes with Altered PAM Specificities," bioRxiv 091611; doi: http://dx.doi.org/10.1101/091611 Epub Dec. 4, 2016.

Smargon et al. (2017), "Cas13b Is a Type VI-B CRISPR-Associated RNA-Guided RNase Differentially Regulated by Accessory Proteins Csx27 and Csx28," Molecular Cell 65, 618-630 (Feb. 16, 2017) doi: 10.1016/j.molcel.2016.12.023. Epub Jan. 5, 2017.

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)— associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epi static gene interactions.

Konermann et al. (2013) addressed the need in the art for versatile and robust technologies that enable optical and chemical modulation of DNA-binding domains based CRISPR Cas9 enzyme and also Transcriptional Activator Like Effectors.

Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knock-out (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

End Edits

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells. In addition, mention is made of PCT application PCT/US14/70057, entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30C, e.g., 20-25C, e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a Ch6 alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising crRNA and/or Cas13b as in the instant invention and components that form a particle, e.g., as in the Particle Delivery PCT, to form a particle and particles from such admixing (or, of course, other particles involving crRNA and/or Cas13b as in the instant invention).

The present invention will be further illustrated in the following Examples which are given for illustration purposes only and are not intended to limit the invention in any way.

EXAMPLES

Example 1: Identification of Cas13b Orthologs

Cas13b proteins shown in Table 1A and Table 1B below are advantageously from codon optimization for expression in mammalian cells. Fusion constructs of each of the Cas13b orthologues with mCherry and optionally NLS or NES are made and cloned in a mammalian expression vector. The various Cas13b orthologues are transfected in HEK293T cells and cellular localization is evaluated based on mCherry expression. Localizations of different Cas13b orthologues fused to a C-terminal and N-terminal NES, fused to a C-terminal and N-terminal NLS, or without NES or NLS fusion are determined. NES fusions efficiently result in cytoplasmic localization of the Cas13b protein. NLS fusions efficiently result in nuclear localization of the Cas13b protein. Variably, also nucleolar localization can be observed with NLS fusions.

TABLE 1A

| Sinomicrobium oceani | WP_072319476.1 | MESTTTLGLHLKYQHDLFEDKHYFGGGVNLAVQNIESIFQAFA ERYGIQNPLRKNGVPAINNIFHDNISISNYKEYLKFLKQYLPVVG FLEKSNEINIFEFREDFEILINAIYKLRHFYTHYYHSPIKLEDRFYT CLNELFVAVAIQVKKHKMKSDKTRQLLNKNLHQLLQQLIEQKR EKLKDKKAEGEKVSLDTKSIENAVLNDAFVHLLDKDENIRLNY SSRLSEDIITKNGITLSISGLLFLLSLFLQRKEAEDLRSRIEGFKGK GNELRFMATHWVFSYLNVKRIKHRLNTDFQKETLLIQIADELSK VPDEVYKTLDHENRSKFLEDINEYIREGNEDASLNESTVVHGVI RKRYENKFHYLVLRYLDEFVDFPSLRFQVHLGNYIHDRRDKVI DGTNFITNRVIKEPIKVFGKLSHVSKLKSDYMESLSREHKNGWD VFPNPSYNFVGHNIPIFINLRSASSKGKELYRDLMKIKSEKKKKS REEGIPMERRDGKPTKIEISNQIDRNIKDNNFKDIYPGEPLAMLS LNELPALLFELLRRPSITPQDIEDRMVEKLYERFQIIRDYKPGDG LSTSKISKKLRKADNSTRLDGKKLLRAIQTETRNAREKLHTLEE NKALQKNRKRRTVYTTREQGREASWLAQDLKRFMPIASRKEW RGYHHSQLQQILAFYDQNPKQPLELLEQFWDLKEDTYVWNSWI HKSLSQHNGFVPMYEGYLKGRLGYYKKLESDIIGFLEEHKVLK RYYTQQHLNVIFRERLYFIKTETKQKLELLARPLVFPRGIFDDKP TFVQDKKVVDHPELFADWYVYSYKDDHSFQEFYHYKRDYNEI FETELSWDIDFKDNKRQLNPSEQMDLFRMKWDLKIKKIKIQDIF LKIVAEDIYLKIFGHKIPLSLSDFYISRQERLTLDEQAVAQSMRLP GDTSENQIKESNLWQTTVPYEKEQIREPKIKLKDIGKFKYFLQQ QKVLNLLKYDPQHVWTKAELEEELYIGKHSYEVVRREMLLQK CHQLEKHILEQFRFDGSNHPRELEQGNHPNFKMYIVNGILTKRG ELEIEAENWWLELGNSKNSLDKVEVELLTMKTIPEQKAFLLILIR NKFAHNQLPADNYFHYASNLMNLKKSDTYSLFWFTVADTIVQ EFMSL (SEQ ID NO: 31) |

| Prevotella intermedia | 12 | MEDDKKTTDSIRYELKDKHFWAAFLNLARHNVYITVNHINKIL
EEDEINRDGYENTLENSWNEIKDINKKDRLSKLIIKHFPPFLEATT
YRQNPTDTTKQKEEKQAEAQSLESLKKSFFVFIYKLRDLRNHYS
HYKHSKSLERPKFEEDLQNKMYNIFDVSIQFVKEDYKHNTDINP
KKDFKHLDRKRKGKFHYSFADNEGNITESGLLFFVSLFLEKKDA
IWVQKKLEGFKCSNKSYQKMTNEVFCRSRMLLPKLRLESTQTQ
DWILLDMLNELIRCPKSLYERLQGVNRKKFYVSFDPADEDYDA
EQEPFKNTLVRHQDRFPYFALRYFDYNEVFANLRFQIDLGTYHF
SIYKKLIGGQKEDRHLTHKLYGFERIQEFDKQNRPDEWKAIVKD
SDTFKKKEEKEEEKPYISETTPHYHLENKKIGIAFKNHNIWPSTQ
TELTNNKRKKYNLGTSIKAEAFLSVHELLPMMFYYLLLKTENT
KNDNKVGGKKETKKQGKHKIEAIIESKIKDIYALYDAFANGEIN
SEDELKEYLKGKDIKIVHLPKQMIAILKNEHKDMAEKAEAKQE
KMKLATENRLKTLDKQLKGKIQNGKRYNSAPKSGEIASWLVN
DMMRFQPVQKDENGESLNNSKANSTEYQLLQRTLAFFGSEHER
LAPYFKQTKLIESSNPHPFLNDTEWEKCSNILSFYRSYLKARKNF
LESLKPEDWEKNQYFLMLKEPKTNRETLVQGWKNGFNLPRGFF
TEPIRKWFMEHWKSIKVDDLKRVGLVAKVTPLFFSEKYKDSVQ
PFYNYPFNVGDVNKPKEEDFLHREERIELWDKKKDKFKGYKA
KKKFKEMTDKEKEEHRSYLEFQSWNKFERELRLVRNQDIVTWL
LCTELIDKLKIDELNIKELKKLRLKDINTDTAKKEKNNILNRVMP
MELPVTVYKVNKGGYIIKNKPLHTIYIKEAETKLLKQGNFKALV
KDRRLNGLFSFVKTPSEAESESNPISKLRVEYELGKYQNARLDII
EDMLALEKKLIDKYNSLDTDNFHNMLTGWLELKGEAKKARFQ
NDVKLLTAVRNAFSHNQYPMYDENLFGNIERFSLSSSNIIESKGL
DIAAKLKEEVSKAAKKIQNEEDNKKEKET (SEQ ID NO: 32) |
| Porphyromonas gingivalis | 19 | MTEQNEKPYNGTYYTLEDKHFWAAFLNLARHNAYITLAHIDR
QLAYSKADITNDEDILFFKGQWKNLDNDLERKARLRSLILKHFS
FLEGAAYGKKLFESQSSGNKSSKKKELSKKEKEELQANALSLD
NLKSILFDFLQKLKDFRNYYSHYRHPESSELPLFDGNMLQRLYN
VFDVSVQRVKRDHEHNDKVDPHRHFNHLVRKGKKDKYGNND
NPPFFKHHFVDREGTVTEAGLLFFVSLFLEKRDAIWMQKKIRGFK
GGTEAYQQMTNEVFCRSRISLPKLKLESLRTDDWMLLDMLNEL
VRCPKSLYDRLREEDRARFRVPVDILSDEDDTDGTEEDPFKNTL
VRHQDRFPYFALRYFDLKKVFTSLRFHIDLGTYHFAIYKKNIGE
QPEDRHLTRNLYGFGRIQDFAEEHRPEEWKRLVRDLDYFETGD
KPYITQTTPHYHIEKGKIGLRFVPEGQHLWPSPEVGATRTGRSK
YAQDKRLTAEAFLSVHELMPMMFYYFLLREKYSEEVSAEKVQ
GRIKRVIEDVYAVYDAFARDEINTRDELDACLADKGIRRGHLPR
QMIAILSQEHKDMEEKVRKKLQEMIADTDHRLDMLDRQTDRKI
RIGRKNAGLPKSGVVADWLVRDMMRFQPVAKDTSGKPLNNSK
ANSTEYRMLQRALALFGGEKERLTPYFRQMNLTGGNNPHPFLH
ETRWESHTNILSFYRSYLEARKAFLQSIGRSDRVENHRPLLLKEP
KTDRQTLVAGWKGEFHLPRGIFTEAVRDCLIEMGYDEVGSYKE
VGFMAKAVPLYFERASKDRVQPFYDYPFNVGNSLKPKKGRFLS
KEKRAEEWESGKERFRLAKLKKEILEAKEHPYHDFKSWQKFER
ELRRLVKNQDIITWMMCRDLMEENKVEGLDTGTLYLKDIRTDV
QEQGSLNVLNRVKPMRLPVVVYRADSRGHVHKEQAPLATVYI
EERDTKLLKQGNFKSFVKDRRLNGLFSFVDTGALAMEQYPISK
LRVEYELAKYQTARVCAFEQTLELEESLLTRYPHLPDKNFRKM
LESWSDPLLDKWPDLHGNVRLLIAVRNAFSHNQYPMYDETLFS
(SEQ ID NO: 33) |
| A2033_10205 [Bacteroidetes bacterium GWA2_31_9] | OFX18020.1 | SIRKYDPSSPDAIEERMGLNIAHRLSEEVKQAKEMVERIIQA
MENQTQKGKGIYYYTKNEDKHYFGSFLNLANNNIEQIIEEFRI
RLSLKDEKNIKEIINNYFTDKKSYTDWERGINILKEYLPVIDYLD
LAITDKEFEKIDLKQKETAKRKYFRTNFSLLIDTIIDLRNFYTHYF
HKPISINPDVAKFLDKNLLNVCLDIKKQKMKTDKTKQALKDGL
DKELKKLIELKKAELKEKKIKTWNITENVEGAVYNDAFNHMVY
KNNAGVTILKDYHKSILPDDKIDSELKLNFSISGLVFLLSMPLSK
KEIEQFKSNLEGFKGKVIGENGEYEISKFNNSLKYMATHWIFSY
LTFKGLKQRVKNTFDKETLLMQMIDELNKVPHEVYQTLSKEQQ
NEFLEDINEYVQDNEENKKSMENSIVVHPVIRKRYDDKFNYFAI
RFLDEFANFPTLKFFVTAGNFVHDKREKQIQGSMLTSDRMIKEK
INVFGKLTEIAKYKSDYFSNENTLETSEWELFPNPSYLLIQNNIPV
HIDLIHNTEEAKQCQIAIDRIKCTTNPAKKRNTRKSKEEIIKIIYQ
KNKNIKYGDPTALLSSNELPALIYELLVNKKSGKELENIIVEKIV
NQYKTIAGFEKGQNLSNSLITKKLKKSEPNEDKINAEKIILAINRE
LEITENKLNIIKNNRAEFRTGAKRKHIFYSKELGQEATWIAYDLK
RFMPEASRKEWKGFHHSELQKFLAFYDRNKNDAKALLNMFW
NFDNDQLIGNDLNSAFREFHFDKFYEKYLIKRDEILEGFKSFISN
FKDEPKLLKKGIKDIYRVFDKRYYIIKSTNAQKEQLLSKPICLPR
GIFDNKPTYIEGVKVESNSALFADWYQYTYSDKHEFQSFYDMP
RDYKEQFEKFELNNIKSIQNKKNLNKSDKFIYFRYKQDLKIKQIK
SQDLFIKLMVDELFNVVFKNNIELNLKKLYQTSDERFKNQLIAD
VQKNREKGDTSDNKMNENFIWNMTIPLSLCNGQIEEPKVKLKD
IGKFRKLETDDKVIQLLEYDKSKVWKKLEIEDELENMPNSYERI
RREKLLKGIQEFEHFLLEKEKFDGINHPKHFEQDLNPNFKTYVIN |

| | | |
|---|---|---|
| | | GVLRKNSKLNYTEIDKLLDLEHISIKDIETSAKEIHLAYFLIHVRN
KFGHNQLPKLEAFELMKKYYKKNNEETYAEYFHKVSSQIVNEF
KNSLEKHS (SEQ ID NO: 34) |
| SAMN05421542_
0666
[Chryseo-
bacterium
jejuense] | SDI27289.1 | MEKTQTGLGIYYDHTKLQDKYFFGGFFNLAQNNIDNVIKAFIIK
FFPERKDKDINIAQFLDICFKDNDADSDFQKKNKFLRIHFPVIGF
LTSDNDKAGFKKKFALLLKTISELRNFYTHYYHKSIEFPSELFEL
LDDIFVKTTSEIKKLKKKDDKTQQLLNKNLSEEYDIRYQQQIER
LKELKAQGKRVSLTDETAIRNGVFNAAFNHLIYRDGENVKPSR
LYQSSYSEPDPAENGISLSQNSILFLLSMFLERKETEDLKSRVKG
FKAKIIKQGEEQISGLKFMATHWVFSYLCFKGIKQKLSTEFHEET
LLIQIIDELSKVPDEVYSAFDSKTKEKFLEDINEYMKEGNADLSL
EDSKVIHPVIRKRYENKFNYFAIRFLDEYLSSTSLKFQVHVGNY
VHDRRVKHINGTGFQTERIVKDRIKVFGRLSNISNLKADYIKEQ
LELPNDSNGWEIFPNPSYIFIDNNVPIHVLADEATKKGIELFKDK
RRKEQPEELQKRKGKISKYNIVSMIYKEAKGKDKLRIDEPLALL
SLNEIPALLYQILEKGATPKDIELIIKNKLTERFEKIKNYDPETPAP
ASQISKRLRNNTTAKGQEALNAEKLSLLIEREIENTETKLSSIEEK
RLKAKKEQRRNTPQRSIFSNSDLGRIAAWLADDIKRFMPAEQRK
NWKGYQHSQLQQSLAYFEKRPQEAFLLLKEGWDTSDGSSYWN
NWVMNSFLENNHFEKFYKNYLMKRVKYFSELAGNIKQHTHNT
KFLRKFIKQQMPADLFPKRHYILKDLETEKNKVLSKPLVFSRGL
FDNNPTFIKGVKVTENPELFAEWYSYGYKTEHVFQHFYGWERD
YNELLDSELQKGNSFAKNSIYYNRESQLDLIKLKQDLKIKKIKIQ
DLFLKRIAEKLFENVFNYPTTLSLDEFYLTQEERAEKERIALAQS
LREEGDNSPNIIKDDFIWSKTIAFRSKQIYEPAIKLKDIGKFNRFV
LDDEESKASKLLSYDKNKIWNKEQLERELSIGENSYEVIRREKL
FKEIQNLELQILSNWSWDGINHPREFEMEDQKNTRHPNFKMYL
VNGILRKNINLYKEDEDFWLESLKENDFKTLPSEVLETKSEMVQ
LLFLVILIRNQFAHNQLPEIQFYNFIRKNYPEIQNNTVAELYLNLI
KLAVQKLKDNS (SEQ ID NO: 35) |
| SAMN05444360_
11366
[Chryseo-
bacterium
carnipullorum] | SHM52812.1 | MNTRVTGMGVSYDHTKKEDKHFFGGFLNLAQDNITAVIKAFCI
KFDKNPMSSVQFAESCFTDKDSDTDFQNKVRYVRTHLPVIGYL
NYGGDRNTFRQKLSTLLKAVDSLRNFYTHYYHSPLALSTELFEL
LDTVFASVAVEVKQHKMKDDKTRQLLSKSLAEELDIRYKQQLE
RLKELKEQGKNIDLRDEAGIRNGVLNAAFNHLIYKEGEIAKPTL
SYSSFYYGADSAENGITISQSGLLFLLSMFLGKKEIEDLKSRIRGF
KAKIVRDGEENISGLKFMATHWIFSYLSFKGMKQRLSTDFHEET
LLIQIIDELSKVPDEVYHDFDTATREKFVEDINEYIREGNEDFSLG
DSTIIHPVIRKRYENKFNYFAVRFLDEFIKFPSLRFQVHLGNFVH
DRRIKDIHGTGFQTERVVKDRIKVFGKLSETSSLKTEYIEKELDL
DSDTGWEIFPNPSYVFIDNNIPIYISTNKTFKNGSSEFIKLRRKEKP
EEMKMRGEDKKEKRDIASMIGNAGSLNSKTPLAMLSLNEMPAL
LYEILVKKTTPEEIELIIKEKLDSHFENIKNYDPEKPLPASQISKRL
RNNTTDKGKKVINPEKLIHLINKEIDATEAKFALLAKNRKELKE
KFRGKPLRQTIFSNMELGREATWLADDIKRFMPDILRKNWKGY
QHNQLQQSLAFFNSRPKEAFTILQDGWDFADGSSFWNGWIINSF
VKNRSFEYFYEAYFEGRKEYFSSLAENIKQHTSNHRNLRRFIDQ
QMPKGLFENRHYLLENLETEKNKILSKPLVFPRGLFDTKPTFIKG
IKVDEQPELFAEWYQYGYSTEHVFQNFYGWERDYNDLLESELE
KDNDFSKNSIHYSRTSQLELIKLKQDLKIKKIKIQDLFLKLIAGHI
FENIFKYPASFSLDELYLTQEERLNKEQEALIQSQRKEGDHSDNII
KDNFIGSKTVTYESKQISEPNVLKKDIGKFNRFLLDDKVKTLLS
YNEDKVVWNKNDLDLELSIGENSYEVIRREKLFKKIQNFELQTLT
DWPWNGTDHPEEFGTTDNKGVNHPNFKMYVVNGILRKHTDW
FKEGEDNWLENLNETHFKNLSFQELETKSKSIQTAFLIIIVIIRNQF
AHNQLPAVQFFEFIQKKYPEIQGSTTSELYLNFINLAVVELLELL
EK (SEQ ID NO: 36) |
| SAMN05421786_
1011119
[Chryseo-
bacterium
ureilyticum] | SIS70481.1 | METQILGNGISYDHTKTEDKHFFGGFLNTAQNNIDLLIKAYISKF
ESSPRKLNSVQFPDVCFKKNDSDADFQHKLQFIRKHLPVIQYLK
YGGNREVLKEKFRLLLQAVDSLRNFYTHFYHKPIQLPNELLTLL
DTIFGEIGNEVRQNKMKDDKTREILLKKNLSEELDFRYQEQLER
LRKLKSEGKKVDLRDTEAIRNGVLNAAFNHLIFKDAEDFKPTVS
YSSYYYDSDTAENGISISQSGLLFLLSMFLGRREMEDLKSRVRG
FKARIIKHEEQHVSGLKFMATHWVFSEFCFKGIKTRLNADYHEE
TLLIQLIDELSKVPDELYRSFDVATRERFIEDINEYIRDGKEDKSL
IESKIVHPVIRKRYESKFNYFAIRFLDEFVNPPTLRFQVHAGNYV
HDRRIKSIEGTGFKTERLVKDRIKVFGKLSTISSLKAEYLAKAVN
ITDDTGWELLPHPSYVFIDNNIPIHLTVDPSFKNGVKEYQEKRKL
QKPEEMKNRQGGDKMHKPAISSKIGKSKDINPESPVALLSMNEI
PALLYEILVKKASPEEVEAKIRQKLTAVFERIRDYDPKVPLPASQ
VSKRLRNNTDTLSYNKEKLVELANKEVEQTERKLALITKNRRE
CREKVKGKFKRQKVFKNAELGTEATWLANDIKRFMPEEQKKN
WKGYQHSQLQQSLAFFESRPGEARSLLQAGWDFSDGSSFWNG
WVMNSFARDNTFDGFYESYLNGRMKYFLRLADNIAQQSSTNK
LISNFIKQQMPKGLFDRRLYMLEDLATEKNKILSKPLIPPRGIFD
DKPTFKKGVQVSEEPEAFADWYSYGYDVKHKFQEFYAWDRD |

| | | |
|---|---|---|
| | | YEELLREELEKDTAFTKNSIHYSRESQIELLAKKQDLKVKKVRI<br>QDLYLKLMAEFLFENVFGHELALPLDQFYLTQEERLKQEQEAIV<br>QSQRPKGDDSPNIVKENFIWSKTIPFKSGRVFEPNVKLKDIGKFR<br>NLLTDEKVDILLSYNNTEIGKQVIENELIIGAGSYEFIRREQLFKEI<br>QQMKRLSLRSVRGMGVPIRLNLK (SEQ ID NO: 37) |
| Reichen-<br>bachiella<br>agariperforans | WP_<br>073124441.1 | MKTNPLIASSGEKPNYKKFNTESDKSFKKIFQNKGSIAPIAEKAC<br>KNFEIKSKSPVNRDGRLHYFSVGHAFKNIDSKNVFRYELDESQM<br>DMKPTQFLALQKEFFDFQGALNGLLKHIRNVNSHYVHTFEKLEI<br>QSINQKLITFLIEAFELAVIHSYLNEEELSYEAYKDDPQSGQKLV<br>QFLCDKFYPNKEHEVEERKTILAKNKRQALEHLLFIEVTSDIDW<br>KLFEKHKVFTISNGKYLSFHACLFLLSLFLYKSEANQLISKIKGF<br>KRNDDNQYRSKRQIFTFFSKKFTSQDVNSEEQHLVKFRDVIQYL<br>NHYPSAWNKHLELKSGYPQMTDKLMRYIVEAEIYRSFPDQTDN<br>HRFLLFAIREFFGQSCLDTWTGNTPINFSNQEQKGFSYEINTSAEI<br>KDIETKLKALVLKGPLNFKEKKEQNRLEKDLRREKKEQPTNRV<br>KEKLLTRIQHNMLYVSYGRNQDRFMDFAARFLAETDYFGKDA<br>KFKMYQFYTSDEQRDHLKEQKKELPKKEFEKLKYHQSKLVDY<br>FTYAEQQARYPDWDTPFVVENNAIQIKVTLFNGAKKIVSVQRN<br>LMLYLLEDALYSEKRENAGKGLISGYFVHHQKELKDQLDILEK<br>ETEISREQKREFKKLLPKRLLHRYSPAQINDTTEWNPMEVILEEA<br>KAQEQRYQLLLEKAILHQTEEDFLKRNKGKQFKLRFVRKAWH<br>LMYLKELYMNKVAEHGHHKSFHITKEEFNDFCRWMFAFDEVP<br>KYKEYLCDYFSQKGFFNNAEFKDLIESSTSLNDLYEKTKQRFEG<br>WSKDLTKQSDENKYLLANYESMLKDDMLYVNISHFISYLESKG<br>KINRNAHGHIAYKALNNVPHLIEEYYYKDRLAPEEYKSHGKLY<br>NKLKTVKLEDALLYEMAMHYLSLEPALVPKVKTKVKDILSSNI<br>AFDIKDAAGHHLYHLLIPPHKIDSFVALINHQSQQEKDPDKTSFL<br>AKIQPYLEKVKNSKDLKAVYHYYKDTPHTLRYEDLNMIHSHIV<br>SQSVQFTKVALKLEEYFIAKKSITLQIARQISYSEIADLSNYFTDE<br>VRNTAFHFDVPETAYSMILQGIESEFLDREIKPQKPKSLSELSTQ<br>QVSVCTAFLETLHNNLFDRKDDKKERLSKARERYFEQIN<br>(SEQ ID NO: 38) |

| TABLE 1B | | |
|---|---|---|
| Bergeyella<br>zoohelcum | 1 | MENKTSLGNNIYYNPFKPQDKSYFAGYFNAAMENTDSVFRELG<br>KRLKGKEYTSENFFDAIFKENISLVEYERYVKLLSDYFPMARLL<br>DKKEVPIKERKENFKKNFKGIIKAVRDLRNFYTHKEHGEVEITD<br>EIFGVLDEMLKSTVLTVKKKKVKTDKTKEILKKSIEKQLDILCQ<br>KKLEYLRDTARKIEEKRRNQRERGEKELVAPFKYSDKRDDLIA<br>AIYNDAFDVYIDKKKDSLKESSKAKYNTKSDPQQEEGDLKIPIS<br>KNGVVFLLSLFLTKQEIHAFKSKIAGFKATVIDEATVSEATVSHG<br>KNSICFMATHEIFSHLAYKKLRKVRTAEINYGEAENAEQLSVY<br>AKETLMMQMLDELSKVPDVVYQNLSEDVQKTFIEDWNEYLKE<br>NNGDVGTMEEEQVIHPVIRKRYEDKFNYFAIRFLDEFAQFPTLR<br>FQVEILGNYLHDSRPKENLISDRRIKEKITVFGRLSELEHKKALFI<br>KNTETNEDREHYWEIFPNPNYDFPKENISVNDKDFPIAGSILDRE<br>KQPVAGKIGIKVKLLNQQYVSEVDKAVKAHQLKQRKASKPSIQ<br>NIIEEIVPINESNPKEAIVFGGQPTAYLSMNDIHSILYEFFDKWEK<br>KKEKLEKKGEKELRKEIGKELEKKIVGKIQAQIQQIIDKDTNAKI<br>LKPYQDGNSTAIDKEKLIKDLKQEQNILQKLKDEQTVREKEYN<br>DFIAYQDKNREINKVRDRNHKQYLKDNLKRKYPEAPARKEVL<br>YYREKGKVAVWLANDIKRFMPTDFKNEWKGEQHSLLQKSLAY<br>YEQCKEELKNLLPEKVFQHLPFKLGGYFQQKYLYQFYTCYLDK<br>RLEYISGLVQQAENFKSENKVFKKVENECFKFLKKQNYTHKEL<br>DARVQSILGYPIFLERGFMDEKPTIIKGKTFKGNEALFADWFRY<br>YKEYQNFQTFYDTENYPLVELEKKQADRKRKTKIYQQKKNDV<br>FTLLMAKHIFKSVFKQDSIDQFSLEDLYQSREERLGNQERARQT<br>GERNTNYIWNKTVDLKLCDGKITVENVKLKNVGDFIKYEYDQR<br>VQAFLKYEENIEWQAFLIKESKEEENYPYVVEREIEQYEKVRRE<br>ELLKEVHLIEEYILEKVKDKEILKKGDNQNFKYYILNGLLKQLK<br>NEDVESYKVFNLNTEPEDVNINQLKQEATDLEQKAFVLTYIRN<br>KFAHNQLPKKEFWDYCQEKYGKIEKEKTYAEYFAEVFKKEKE<br>ALIK (SEQ ID NO: 39) |
| Prevotella<br>intermedia | 2 | MEDDKKTTDSIRYELKDKHFWAAFLNLARHNVYITVNHINKIL<br>EEGEINRDGYETTLKNTWNEIKDINKKDRLSKLIIKHFPPFLEAT<br>YRLNPTDTTKQKEEKQAEAQSLESLRKSFFVFIYKLRDLRNHYS<br>HYKHSKSLERPKFEEGLLEKMYNIFNASIRLVKEDYQYNKDINP<br>DEDFKHLDRTEEEFNYYFTKDNEGNITESGLLFFVSLFLEKKDAI<br>WMQQKLRGFKDNRENKKKMTNEVFCRSRMLLPKLRLQSTQTQ<br>DWILLDMLNELIRCPKSLYERLREEDREKFRVPIEIADEDYDAEQ<br>EPFKNTLVRHQDRFPYFALRYFDYNEIFTNLRFQIDLGTYHFSTY<br>KKQIGDYKESHHLTHKLYGFERIQEFTKQNRPDEWRKFVKTFN<br>SFETSKEPYIPETTPHYLENQKIGIRFRNDNDKIWPSLKTNSEK<br>NEKSKYKLDKSFQAEAFLSVHELLPMMFYYLLLKTENTDNDNE<br>IETKKKENKNDKQEKHKIEEIIENKITEIYALYDTFANGEIKSIDE<br>LEEYCKGKDIEIGHLPKQMIAILKDEHKVMATEAERKQEEMLV |

-continued

| | | |
|---|---|---|
| | | DVQKSLESLDNQINEEIENVERKNSSLKSGKIASWLVNDMMRF<br>QPVQKDNEGKPLNNSKANSTEYQLLQRTLAFFGSEHERLAPYF<br>KQTKLIESSNPHPFLKDTEWEKCNNILSFYRSYLEAKKNFLESLK<br>PEDWEKNQYFLKLKEPKTKPKTLVQGWKNGFNLPRGIFTEPIRK<br>WFMKHRENITVAELKRVGLVAKVIPLFFSEEYKDSVQPFYNYH<br>FNVGNINKPDEKNFLNCEERRELLRKKKDEFKKMTDKEKEENP<br>SYLEFKSWNKFERELRLVRNQDIVTWLLCMELFNKKKIKELNV<br>EKIYLKNINTNTTKKEKNTEEKNGEEKNIKEKNNILNRIMPMRL<br>PIKVYGRENFSKNKKKKIRRNTFFTVYIEEKGTKLLKQGNFKAL<br>ERDRRLGGLFSFVKTPSKAESKSNTISKLRVEYELGEYQKARIEII<br>KDMLALEKTLIDKYNSLDTDNFNKMLTDWLELKGEPDKASFQ<br>NDVDLLIAVRNAFSHNQYPMRNRIAFANINPFSLSSANTSEEKG<br>LGIANQLKDKTHKTIEKIIEIEKPIETKE (SEQ ID NO: 40) |
| *Prevotella buccae* | 3 | MQKQDKLFVDRKKNAIFAFPKYITIMENKEKPEPIYYELTDKHF<br>WAAFLNLARHNVYTTINHINRRLEIAELKDDGYMMGIKGSWNE<br>QAKKLDKKVRLRDLIMKHFPFLEAAAYEMTNSKSPNNKEQRE<br>KEQSEALSLNNLKNVLFIFLEKLQVLRNYYSHYKYSEESPKPIFE<br>TSLLKNMYKVFDANVRLVKRDYMHHENIDMQRDFTHLNRKK<br>QVGRTKNIIDSPNFHYHFADKEGNMTIAGLLFFVSLFLDKKDAI<br>WMQKKLKGFKDGRNLREQMTNEVFCRSRISLPKLKLENVQTK<br>DWMQLDMLNELVRCPKSLYERLREKDRESFKVPFDIFSDDYNA<br>EEEPFKNTLVRHQDRFPYFVLRYFDLNEIFEQLRFQIDLGTYHFS<br>IYNKRIGDEDEVRHLTHHLYGFARIQDFAPQNQPEEWRKLVKD<br>LDHFETSQEPYISKTAPHYHLENEKIGIKFCSAHNNLFPSLQTDK<br>TCNGRSKFNLGTQPFTAEAFLSVHELLPMMFYYLLLTKDYSRKE<br>SADKVEGIIRKEISNIYAIYDAFANNEINSIADLTRRLQNTNILQG<br>HLPKQMISILKGRQKDMGKEAERKIGEMIDDTQRRLDLLCKQT<br>NQKIRIGKRNAGLLKSGKIADWLVNDMMRFQPVQKDQNNIPIN<br>NSKANSTEYRMLQRALALFGSENFRLKAYFNQMNLVGNDNPH<br>PFLAETQWEHQTNILSFYRNYLEARKKYLKGLKPQNWKQYQH<br>FLILKVQKTNRNTLVTGWKNSFNLPRGIFTQPIREWFEKHNNSK<br>RIYDQILSFDRVGFVAKAIPLYFAEEYKDNVQPFYDYPFNIGNRL<br>KPKKRQFLDKKERVELWQKNKELFKNYPSEKKKTDLAYLDFLS<br>WKKFERELRLIKNQDIVTWLMFKELFNMATVEGLKIGEIHLRDI<br>DTNTANEESNNILNRIMPMKLPVKTYETDNKGNILKERPLATFY<br>IEETETKVLKQGNFKALVKDRRLNGLFSFAETTDLNLEEHPISKL<br>SVDLELIKYQTTRISIFEMTLGLEKKLIDKYSTLPTDSFRNMLER<br>WLQCKANRPELKNYVNSLIAVRNAFSHNQYPMYDATLFAEVK<br>KFTLFPSVDTKKIELNIAPQLLEIVGKAIKEIEKSENKN<br>(SEQ ID NO: 41) |
| *Porphyromonas gingivalis* | 4 | MNTVPASENKGQSRTVEDDPQYFGLYLNLARENLIEVESHVRIK<br>FGKKKLNEESLKQSLLCDHLLSVDRWTKVYGHSRRYLPPLHYF<br>DPDSQIEKDHDSKTGVDPDSAQRLIRELYSLLDFLRNDFSHNRL<br>DGTTFEHLEVSPDISSFITGTYSLACGRAQSRFAVFFKPDDFVLA<br>KNRKEQLISVADGKECLTVSGFAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLDEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELRLLDPSSGHPFLSATMETAHRYTEGFYKCYLEKKREWLAK<br>IFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIHGKSVSYIPSDGKKFADCYTHL<br>MEKTVRDKKRELRTAGKPVPPDLAADIKRSEHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHPPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL<br>(SEQ ID NO: 42) |
| *Bacteroides pyogenes* | 5 | MESIKNSQKSTGKTLQKDPPYFGLYLNMALLNVRKVENHIRKW<br>LGDVALLPEKSGFHSLLTTDNLSSAKWTRFYYKSRKFLPFLEMF<br>DSDKKSYENRRETAECLDTIDRQKISSLLKEVYGKLQDIRNAFS<br>HYHIDDQSVKHTALIISSEMHRFIENAYSFALQKTRARFTGVFVE<br>TDFLQAEEKGDNKKFFAIGGNEGIKLKDNALIFLICLFLDREEAF<br>KFLSRATGFKSTKEKGFLAVRETFCALCCRQPHERLLSVNPREA<br>LLMDMLNELNRCPDILFEMLDEKDQKSFLPLLGEEEQAHILENS<br>LNDELCEAIDDPFEMIASLSKRVRYKNRFPYLMLRYIEEKNLLPF<br>IRFRIDLGCLELASYPKKMGEENNYERSVTDHAMAFGRLTDFH |

| | | |
|---|---|---|
| | | NEDAVLQQITKGITDEVRFSLYAPRYAIYNNKIGFVRTSGSDKIS
FPTLKKKGGEGHCVAYTLQNTKSFGEISIYDLRKILLLSFLDKDK
AKNIVSGLLEQCEKHWKDLSENLFDAIRTELQKEFPVLIRYTLP
RSKGGKLVSSKLADKQEKYESEFERRKEKLTEILSEKDFDLSQIP
RRMIDEWLNVLPTSREKKLKGYVETLKLDCRERLRVFEKREKG
EHPLPPRIGEMATDLAKDIIRMVIDQGVKQRITSAYYSEIQRCLA
QYAGDDNRRHLDSIIRELRLKDTKNGHPFLGKVLRPGLGHTEK
LYQRYFEEKKEWLEATFYPAASPKRVPRFVNPPTGKQKELPLII
RNLMKERPEWRDWKQRKNSHPIDLPSQLFENEICRLLKDKIGKE
PSGKLKWNEMFKLYWDKEFPNGMQRFYRCKRRVEVFDKVVE
YEYSEEGGNYKKYYEALIDEVVRQKISSSKEKSKLQVEDLTLSV
RRVFKRAINEKEYQLRLLCEDDRLLFMAVRDLYDWKEAQLDL
DKIDNMLGEPVSVSQVIQLEGGQPDAVIKAECKLKDVSKLMRY
CYDGRVKGLMPYFANHEATQEQVEMELRHYEDHRRRVFNWV
FALEKSVLKNEKLRRFYEESQGGCEHRRCIDALRKASLVSEEEY
EFLVHIRNKSAHNQFPDLEIGKLPPNVTSGFCECIWSKYKAIICRI
IPFIDPERRFFGKLLEQK (SEQ ID NO: 43) |
| *Alistipes sp.* ZOR0009 | 6 | MSNEIGAFREHQFAYAPGNEKQEEATFATYFNLALSNVEGMMF
GEVESNPDKIEKSLDTLPPAILRQIASFIWLSKEDHPDKAYSTEE
VKVIVTDLVRRLCFYRNYFSHCFYLDTQYFYSDELVDTTAIGEK
LPYNFHHFITNRLFRYSLPEITLFRWNEGERKYEILRDGLIFFCCL
FLKRGQAERFLNELRFFKRTDEEGRIKRTIFTKYCTRESHKHIGIE
EQDFLIFQDIIGDLNRVPKVCDGVVDLSKENERYIKNRETSNESD
ENKARYRLLIREKDKFPYYLMRYIVDFGVLPCITFKQNDYSTKE
GRGQFHYQDAAVAQEERCYNFVVRNGNVYYSYMPQAQNVVR
ISELQGTISVEELRNMVYASINGKDVNKSVEQYLHLHLLYEKI
LTISGQTIKEGRVDVEDYRPLLDKLLLRPASNGEELRRELRKLLP
KRVCDLLSNRFDCSEGVSAVEKRLKAILLRHEQLLLSQNPALHI
DKIKSVIDYLYLFFSDDEKFRQQPTEKAHRGLKDEEFQMYHYL
VGDYDSHPLALWKELEASGRLKPEMRKLTSATSLHGLYMLCL
KGTVEWCRKQLMSIGKGTAKVEAIADRVGLKLYDKLKEYTPE
QLEREVKLVVMHGYAAAATPKPKAQAAIPSKLTELRFYSFLGK
REMSFAAFIRQDKKAQKLWLRNFYTVENIKTLQKRQAAADAA
CKKLYNLVGEVERVHTNDKVLVLVAQRYRERLLNVGSKCAVT
LDNPERQQKLADVYEVQNAWLSIRFDDLDFTLTHVNLSNLRKA
YNLIPRKHILAFKEYLDNRVKQKLCEECRNVRRKEDLCTCCSPR
YSNLTSWLKENHSESSIEREAATMMLLDVERKLLSFLLDERRKA
IIEYGKFIPFSALVKECRLADAGLCGIRNDVLHDNVISYADAIGK
LSAYFPKEASEAVEYIRRTKEVREQRREELMANSSQ (SEQ ID NO: 44) |
| *Prevotella sp.* MA2016 | 7a | MSKECKKQRQEKKRRLQKANFSISLTGKHVFGAYFNMARTNF
VKTINYILPIAGVRGNYSENQINKMLHALFLIQAGRNEELTTEQK
QWEKKLRLNPEQQTKFQKLLFKHPPVLGPMMADVADHKAYL
NKKKSTVQTEDETFAMLKGVSLADCLDIICLMADTLTECRNFY
THKDPYNKPSQLADQYLHQEMIAKKLDKVVVASRRILKDREGL
SVNEVEFLTGIDHLHQEVLKDEFGNAKVKDGKVMKTFVEYDD
FYFKISGKRLVNGYTVTTKDDKPVNVNTMLPALSDFGLLYFCV
LFLSKPYAKLFIDEVRLFEYSPFDDKENMIIVISEMLSIYRIRTPRL
HKIDSHDSKATLAMDIFGELRRCPMELYNLLDKNAGQPFFHDE
VKHPNSHTPDVSKRLRYDDRFPTLALRYIDETELFKRIRFQLQL
GSFRYKFYDKENCIDGRVRVRRIQKEINGYGRMQEVADKRMD
KWGDLIQKREERSVKLEHEELYINLDQFLEDTADSTPYVTDRRP
AYNIHANRIGLYWEDSQNPKQYKVFDENGMYIPELVVTEDKKA
PIKMPAPRCALSVYDLPAMLFYEYLREQQDNEFPSAEQVIIEYE
DDYRKFFKAVAEGKLKPFKRPKEFRDFLKKEYPKLRMADIPKK
LQLFLCSHGLCYNNKPETVYERLDRLTLQHLEERELHIQNRLEH
YQKDRDMIGNKDNQYGKKSFSDVRHGALARYLAQSMMEWQP
TKLKDKEKGHDKLTGLNYNVLTAYLATYGHPQVPEEGFTPRTL
EQVLINAHLIGGSNPHPFINKVLALGNRNIEELYLHYLEEELKHI
RSRIQSLSSNPSDKALSALPFIREIDRMRYHERTSEEMMALAARY
TTIQLPDGLFTPYILEILQKHYTENSDLQNALSQDVPVKLNPTCN
AAYLITLFYQTVLKDNAQPFYLSDKTYTRNKDGEKAESFSFKR
AYELFSVLNNNKKDTFPPFEMIPLFLTSDEIQERLSAKLLDGDGNP
VPEVGEKGKPATDSQGNTIWKRRIYSEVDDYAEKLTDRDMKIS
FKGEWEKLPRWKQDKIIKRRDETRRQMRDELLQRMPRYIRDIK
DNERTLRRYKTQDMVLFLLAEKMFTNIISEQSSEFNWKQMRLS
KVCNEAFLRQTLTFRVPVTVGETTIYVEQENMSLKNYGEFYRFL
TDDRLMSLLNNIVETLKPNENGDLVIRHTDLMSELAAYDQYRS
TIFMLIQSIENLIITNNAVLDDPDADGFWVREDLPKRNNFASLLE
LINQLNNVELTDDERKLLVAIRNAFSHNSYNIDFSLIKDVKHLPE
VAKGILQHLQSMLGVEITK (SEQ ID NO: 45) |
| *Prevotella sp.* MA2016 | 7b | MSKECKKQRQEKKRRLQKANFSISLTGKHVFGAYFNMARTNF
VKTINYILPIAGVRGNYSENQINKMLHALFLIQAGRNEELTTEQK
QWEKKLRLNPEQQTKFQKLLFKHPPVLGPMMADVADHKAYL
NKKKSTVQTEDETFAMLKGVSLADCLDIICLMADTLTECRNFY
THKDPYNKPSQLADQYLHQEMIAKKLDKVVVASRRILKDREGL
SVNEVEFLTGIDHLHQEVLKDEFGNAKVKDGKVMKTFVEYDD |

|   |   |   |
|---|---|---|
| | | FYFKISGKRLVNGYTVTTKDDKPVNVNTMLPALSDFGLLYFCV<br>LFLSKPYAKLFIDEVRLFEYSPFDDKENMIIVISEMLSIYRIRTPRL<br>HKIDSHDSKATLAMDIFGELRRCPMELYNLLDKNAGQPFFHDE<br>VKHPNSHTPDVSKRLRYDDRFPTLALRYIDETELFKRIRFQLQL<br>GSFRYKFYDKENCIDGRVRVRRIQKEINGYGRMQEVADKRMD<br>KWGDLIQKREERSVKLEHEELYINLDQFLEDTADSTPYVTDRRP<br>AYNIHANRIGLYWEDSQNPKQYKVFDENGMYIPELVVTEDKKA<br>PIKMPAPRCALSVYDLPAMLFYEYLREQQDNEFPSAEQVIIEYE<br>DDYRKFFKAVAEGKLKPFKRPKEFRDFLKKEYPKLRMADIPKK<br>LQLFLCSHGLCYNNKPETVYERLDRLTLQHLEERELHIQNRLEH<br>YQKDRDMIGNKDNQYGKKSFSDVRHGALARYLAQSMMEWQP<br>TKLKDKEKGHDKLTGLNYNVLTAYLATYGHPQVPEEGFTPRTL<br>EQVLINAHLIGGSNPHPFINKVLALGNRNIEELYLHYLEEELKHI<br>RSRIQSLSSNPSDKALSALPFIEIHDRMRYHERTSEEMMALAARY<br>TTIQLPDGLFTPYILEILQKHYTENSDLQNALSQDVPVKLNPTCN<br>AAYLITLFYQTVLKDNAQPFYLSDKTYTRNKDGEKAESFSFKR<br>AYELFSVLNNNKKDTFPFEMIPLFLTSDEIQERLSAKLLDGDGNP<br>VPEVGEKGKPATDSQGNTIWKRRIYSEVDDYAEKLTDRDMKIS<br>FKGEWEKLPRWKQDKIIKRRDETRRQMRDELLQRMPRYIRDIK<br>DNERTLRRYKTQDMVLFLLAEKMFTNIISEQSSEFNWKQMRLS<br>KVCNEAFLRQTLTFRVPVTVGETTIYVEQENMSLKNYGEFYRFL<br>TDDRLMSLLNNIVETLKPNENGDLVIRHTDLMSELAAYDQYRS<br>TIFMLIQSIENLIITNNAVLDDPDADGFWVREDLPKRNNFASLLE<br>LINQLNNVELTDDERKLLVAIRNAFSHNSYNIDFSLIKDVKHLPE<br>VAKGILQHLQSMLGVEITK (SEQ ID NO: 46) |
| *Riemerella<br>anatipestifer* | 8 | MEKPLLPNVYTLKHKFFWGAFLNIARHNAFITICHINEQLGLKT<br>PSNDDKIVDVVCETWNNILNNDHDLLKKSQLTELILKHFPPFLTA<br>MCYHPPKKEGKKKGHQKEQQKEKESEAQSQAEALNPSKLIEAL<br>EILVNQLHSLRNYYSHYKHKKPDAEKDIFKHLYKAFDASLRMV<br>KEDYKAHFTVNLTRDFAHLNRKGKNKQDNPDFNRYRFEKDGF<br>FTESGLLFFTNLFLDKRDAYWMLKKVSGFKASHQREKMTTE<br>VFCRSRILLPKLRLESRYDHNQMLLDMLSELSRCPKLLYEKLSE<br>ENKKHFQVEADGFLDEIEEEQNPFKDTLIRHQDRFPYFALRYLD<br>LNESFKSIRFQVDLGTYHYCIYDKKIGDEQEKRHLTRTLLSFGRL<br>QDFTEINRPQEWKALTKDLDYKETSNQPFISKTTPHYHITDNKIG<br>FRLGTSKELYPSLEIKDGANRIAKYPYNSGFVAHAFISVHELLPL<br>MFYQHLTGKSEDLLKETVRHIQRIYKDFEEERINTIEDLEKANQ<br>GRLPLGAFPKQMLGLLQNKQPDLSEKAKIKIEKLIAETKLLSHR<br>LNTKLKSSPKLGKRREKLIKTGVLADWLVKDFMRFQPVAYDA<br>QNQPIKSSKANSTEFWFIRRALALYGGEKNRLEGYFKQTNLIGN<br>TNPHPFLNKFNWKACRNLVDFYQQYLEQREKFLEAIKNQPWEP<br>YQYCLLLKIPKENRKNLVKGWEQGGISLPRGLFTEAIRETLSED<br>LMLSKPIRKEIKKHGRVGFISRAITLYFKEKYQDKHQSFYNLSY<br>KLEAKAPLLKREEHYEYWQQNKPQSPTESQRLELHTSDRWKD<br>YLLYKRWQHLEKKLRLYRNQDVMLWLMTELTKNHFKELNL<br>NYHQLKLENLAVNVQEADAKLNPLNQTLPMVLPVKVYPATAF<br>GEVQYHKTPIRTVYIREEHTKALKMGNFKALVKDRRLNGLFSFI<br>KEENDTQKHPISQLRLRRELEIYQSLRVDAFKETLSLEEKLLNKH<br>TSLSSLENEFRALLEEWKKEYAASSMVTDEHIAFIASVRNAFCH<br>NQYPFYKEALHAPIPLFTVAQPTTEEKDGLGIAEALLKVLREYC<br>EIVKSQI (SEQ ID NO: 47) |
| *Prevotella<br>aurantiaca* | 9 | MEDDKKTTGSISYELKDKHFWAAFLNLARHNVYITINHINKLLE<br>IREIDNDEKVLDIKTLWQKGNKDLNQKARLRELMTKHFPFLET<br>AIYTKNKEDKKEVKQEKQAEAQSLESLKDCLFLFLDKLQEARN<br>YYSHYKYSEFSKEPEFEEGLLEKMYNIFGNNIQLVINDYQHNKD<br>INPDEDFKHLDRKGQFKYSFADNEGNITESGLLFFVSLFLEKKD<br>AIWMQQKLNGFKDNLENKKKMTHEVFCRSRILMPKLRLESTQT<br>QDWILLDMLNELIRCPKSLYERLQGDDREKFKVPFDPADEDYN<br>AEQEPFKNTLIRHQDRFPYFVLRYFDYNEIFKNLRFQIDLGTYHF<br>SIYKKLIGGQKEDRHLTHKLYGFERIQEFAKQNRPDEWKAIVKD<br>LDTYETSNKRYISETTPHYHLENQKIGIRFRNGNKEIWPSLKTND<br>ENNEKSKYKLDKQYQAEAFLSVHELLPMMFYYLLLKKEKPNN<br>DEINASIVEGFIKREIRNIFKLYDAFANGEINNIDDLEKYCADKGI<br>PKRHLPKQMVAILYDEHKDMVKEAKRKQKEMVKDTKKLLAT<br>LEKQTQKEKEDDGRNVKLLKSGEIARWLVNDMMRFQPVQKD<br>NEGKPLNNSKANSTEYQMLQRSLALYNNEEKPTRYFRQVNLIE<br>SNNPHPFLKWTKWEECNNILTFYYSYLTKKIEFLNKLKPEDWK<br>KNQYFLKLKEPKTNRETLVQGWKNGFNLPRGIFTEPIREWFKR<br>HQNNSKEYEKVEALDRVGLVTKVIPLFFKEEYFKDKEENFKED<br>TQKEINDCVQPFYNFPYNVGNIHKPKEKDFLHREERIELWDKKK<br>DKFKGYKEKIKSKKLTEKDKEEFRSYLEFQSWNKFERELRLVR<br>NQDIVTWLLCKELIDKLKIDELNIEELKKLRLNNIDTDTAKKEK<br>NNILNRVMPMELPVTVYEIDDSHKIVKDKPLHTIYIKEAETKLL<br>KQGNFKALVKDRRLNGLFSFVKTNSEAESKRNPISKLRVEYELG<br>EYQEARIEIIQDMLALEEKLINKYKDLPTNKFSEMLNSWLEGKD<br>EADKARFQNDVDFLIAVRNAFSHNQYPMHNKIEFANIKPFSLYT<br>ANNSEEKGLGIANQLKDKTKETTDKIKKIEKPIETKE (SEQ ID NO: 48) |

| Prevotella saccharolytica | 10 | MEDKPFWAAFFNLARHNVYLTVNHINKLLDLEKLYDEGKHKEI
FEREDIFNISDDVMNDANSNGKKRKLDIKKIWDDLDTDLTRKY
QLRELILKHFPFIQPAIIGAQTKERTTIDKDKRSTSTSNDSLKQTG
EGDINDLLSLSNVKSMFFRLLQILEQLRNYYSHVKHSKSATMPN
FDEDLLNWMRYIFIDSVNKVKEDYSSNSVIDPNTSFSHLIYKDE
QGKIKPCRYPFTSKDGSINAFGLLFFVSLFLEKQDSIWMQKKIPG
FKKASENYMKMTNEVFCRNHILLPKIRLETVYDKDWMLLDML
NEVVRCPLSLYKRLTPAAQNKFKVPEKSSDNANRQEDDNPFSRI
LVRHQNRFPYFVLRFFDLNEVFTTLRFQINLGCYHFAICKKQIGD
KKEVHHLIRTLYGFSRLQNFTQNTRPEEWNTLVKTTEPSSGNDG
KTVQGVPLPYISYTIPHYQIENEKIGIKIFDGDTAVDTDIWPSVST
EKQLNKPDKYTLTPGFKADVFLSVHELLPMMFYYQLLLCEGML
KTDAGNAVEKVLIDTRNAIFNLYDAFVQEKINTITDLENYLQDK
PILIGHLPKQMIDLLKGHQRDMLKAVEQKKAMLIKDTERRLKL
LDKQLKQETDVAAKNTGTLLKNGQIADWLVNDMMRFQPVKR
DKEGNPINCSKANSTEYQMLQRAFAFYATDSCRLSRYFTQLHLI
HSDNSHLFLSRFEYDKQPNLIAFYAAYLKAKLEFLNELQPQNW
ASDNYELLLRAPKNDRQKLAEGWKNGENLPRGLFTEKIKTWFN
EHKTIVDISDCDIFKNRVGQVARLIPVFEDKKEKDHSQPFYRYDF
NVGNVSKPTEANYLSKGKREELFKSYQNKFKNNIPAEKTKEYR
EYKNFSLWKKFERELRLIKNQDILIWLMCKNLFDEKIKPKKDIL
EPRIAVSYIKLDSLQTNTSTAGSLNALAKVVPMTLAIHIDSPKPK
GKAGNNEKENKEFTVYIKEEGTKLLKWGNEKTLLADRRIKGLF
SYIEHDDIDLKQHPLTKRRVDLELDLYQTCRIDIFQQTLGLEAQL
LDKYSDLNTDNFYQMLIGWRKKEGIPRNIKEDTDFLKDVRNAF
SHNQYPDSKKIAFRRIRKFNPKELILEEEEGLGIATQMYKEVEKV
VNRIKRIELFD (SEQ ID NO: 49) |
| HMPREF9712_03108 [Myroides odoratimimus CCUG 10230] | 11 | MKDILTTDTTEKQNRFYSHKIADKYFFGGYFNLASNNIYEVFEE
VNKRNTFGKLAKRDNGNLKNYIIHVFKDELSISDFEKRVAIFAS
YFPILETVDKKSIKERNRTIDLTLSQRIRQFREMLISLVTAVDQLR
NEYTHYHHSDIVIENKVLDFLNSSFVSTALHVKDKYLKTDKTKE
FLKETIAAELDILIEAYKKKQIEKKNTRFKANKREDILNAIYNEA
FWSFINDKDKDKDKETVVAKGADAYFEKNHHKSNDPDFALNIS
EKGIVYLLSFFLTNKEMDSLKANLTGFKGKVDRESGNSIKYMA
TQRIYSFHTYRGLKQKIRTSEEGVKETLLMQMIDELSKVPNVVY
QHLSTTQQNSFIEDWNEYYKDYEDDVETDDLSRVIHPVIRKYE
DRENYFAIRELDEFFDEPTLRFQVHLGDYVHDRRTKQLGKVESD
RIIKEKVTVFARLKDINSAKASYFHSLEEQDKEELDNKWTLPPN
PSYDFPKEHTLQHQGEQKNAGKIGIYVKLRDTQYKEKAALEEA
RKSLNPKERSATKASKYDIITQIIEANDNVKSEKPLVFTGQPIAY
LSMNDIHSMLFSLLTDNAELKKTPEEVEAKLIDQIGKQINEILSK
DTDTKILKKYKDNDLKETDTDKITRDLARDKEEIEKLILEQKQR
ADDYNYTSSTKFNIDKSRKRKHLLFNAEKGKIGVWLANDIKRF
MFKESKSKWKGYQHTELQKLFAYFDTSKSDLELILSNMVMVK
DYPIELIDLVKKSRTLVDFLNKYLEARLEYIENVITRVKNSIGTP
QFKTVRKECFTFLKKSNYTVVSLDKQVERILSNIPLFIERGFMDD
KPTMLEGKSYKQHKEKFADWFVHYKENSNYQNFYDTEVYEIT
TEDKREKAKVTKKIKQQQKNDVFTLMMVNYMLEEVLKLSSND
RLSLNELYQTKEERIVNKQVAKDTQERNKNYIWNKVVDLQLC
DGLVHIDNVKLKDIGNFRKYENDSRVKEFLTYQSDIVWSAYLS
NEVDSNKLYVIERQLDNYESIRSKELLKEVQEIECSVYNQVANK
ESLKQSGNENFKQYVLQGLLPIGMDVREMLILSTDVKFKKEEII
QLGQAGEVEQDLYSLIYIRNKFAHNQLPIKEFFDFCENNYRSISD
NEYYAEYYMEIFRSIKEKYAN (SEQ ID NO: 50) |
| Capnocytophaga canimorsus | 13 | MKNIQRLGKGNEFSPFKKEDKFYFGGFLNLANNNIEDFFKEIITR
FGIVITDENKKPKETFGEKILNEIFKKDISIVDYEKWVNIFADYFP
FTKYLSLYLEEMQFKNRVICFRDVMKELLKTVEALRNFYTHYD
HEPIKIEDRVFYFLDKVLLDVSLTVKNKYLKTDKTKEFLNQHIG
EELKELCKQRKDYLVGKGKRIDKESEIINGIYNNAFKDFICKREK
QDDKENHNSVEKILCNKEPQNKKQKSSATVWELCSKSSSKYTE
KSFPNRENDKHCLEVPISQKGIVFLLSFFLNKGEIYALTSNIKGFK
AKITKEEPVTYDKNSIRYMATHRMFSFLAYKGLKRKIRTSEINY
NEDGQASSTYEKETLMLQMLDELNKVPDVVYQNLSEDVQKTFI
EDWNEYLKENNGDVGTMEEEQVIHPVIRKRYEDKFNYFAIRFL
DEFAQFPTLRFQVHLGNYLCDKRTKQICDTTTEREVKKKITVFG
RLSELENKKAIFLNEREEIKGWEVFPNPSYDFPKENISVNYKDFP
IVGSILDREKQPVSNKIGIRVKIADELQREIDKAIKEKKLRNPKNR
KANQDEKQKERLVNEIVSTNSNEQGEPVVFIGQPTAYLSMNDIH
SVLYEFLINKISGEALETKIVEKIETQIKQIIGKDATTKILKPYTNA
NSNSINREKLLRDLEQQQILKTLLEEQQQREKDKKDKKSKRK
HELYPSEKGKVAVWLANDIKRFNIPKAFKEQWRGYHHSLLQKY
LAYYEQSKEELKNLLPKEVFKHPFKLKGYFQQQYLNQFYTDY
LKRRLSYVNELLLNIQNFKNDKDALKATEKECFKFFRKQNYIIN
PINIQIQSILVYPIFLKRGFLDEKPTMIDREKFKENKDTELADWF
MHYKNYKEDNYQKFYAYPLEKVEEKEKFKRNKQINKQKKND
VYTLMMVEYIIQKIFGDKFVEENPLVLKGIFQSKAERQQNNTHA |

|  |  |  |
|---|---|---|
|  |  | ATTQERNLNGILNQPKDIKIQGKITVKGVLKLKDIGNFRKYEIDQR<br>VNTFLDYEPRKEWMAYLPNDWKEKEKQGQLPPNNVIDRQISK<br>YETVRSKILLKDVQELEKIISDEIKEEHRHDLKQGKYYNFKYYIL<br>NGLLRQLKNENVENYKVFKLNTNPEKVNITQLKQEATDLEQKA<br>FVLTYIRNKFAHNQLPKKEFWDYCQEKYGKIEKEKTYAEYFAE<br>VFKREKEALIK (SEQ ID NO: 51) |
| *Porphyromonas*<br>*gulae* | 14 | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKIDHEHNDEVDPHYHFNHLVRKGKKDRYGHNDNP<br>SFKHHFVDGEGMVTEAGLLFFVSLFLEKRDAIWMQKKIRGFKG<br>GTETYQQMTNEVFCRSRISLPKLKLESLRMDDWMLLDMLNEL<br>VRCPKPLYDRLREDDRACFRVPVDILPDEDDTGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTSPHYHIEKGKIGLRFMPEGQHLWPSPEVGTTRTGRS<br>KYAQDKRLTAEAFLSVHELMPMMFYYFLLREKYSEEVSAERV<br>QGRIKRVIEDVYAVYDAFARDEINTRDELDACLADKGIRRGHLP<br>RQMIAILSQEHKDMEEKIRKKLQEMMADTDHRLDMLDRQTDR<br>KIRIGRKNAGLPKSGVIADWLVRDMMRFQPVAKDASGKPLNNS<br>KANSTEYRMLQRALALFGGEKERLTPYFRQMNLTGGNNPHPFL<br>HETRWESHTNILSFYRSYLRARKAFLERIGRSDRVENRPFLLLKE<br>PKTDRQTLVAGWKGEFHLPRGIFTEAVRDCLIEMGHDEVASYK<br>EVGFMAKAVPLYFERACEDRVQPFYDSPFNVGNSLKPKKGRFL<br>SKEERAEEWERGKERFRDLEAWSYSAARRIEDAFAGIEYASPG<br>NKKKIEQLLRDLSLWEAFESKLKVRADRINLAKLKKEILEAQEH<br>PYHDFKSWQKFERELRLVKNQDIITWMMCRDLMEENKVEGLD<br>TGTLYLKDIRPNVQEQGSLNVLNRVKPMRLPVVVYRADSRGH<br>VHKEEAPLATVYIEERDTKLLKQGNFKSFVKDRRLNGLFSFVDT<br>GGLAMEQYPISKLRVEYELAKYQTARVCVFELTLRLEESLLTRY<br>PHLPDESFREMLESWSDPLLAKWPELHGKVRLLIAVRNAFSHN<br>QYPMYDEAVFSSIRKYDPSSPDAIEERMGLNIAHRLSEEVKQAK<br>ETVERIIQA (SEQ ID NO: 52) |
| *Prevotella*<br>sp. P5-125 | 15 | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDLTNHYKTYEEKLNDGCEFLTSTEQPLSGMINNYYTVALRNM<br>NERYGYKTEDLAFIQDKRFKFVKDAYGKKKSQVNTGFFLSLQD<br>YNGDTQKKLHLSGVGIALLICLFLDKQYINIFLSRLPIFSSYNAQS<br>EERRIIIRSFGINSIKLPKDRIHSEKSNKSVAMDMLNEVKRCPDEL<br>FTTLSAEKQSRFRIISDDHNEVLMKRSSDRFVPLLLQYIDYGKLF<br>DHIRFHVNMGKLRYLLKADKTCIDGQTRVRVIEQPLNGFGRLE<br>EAETMRKQENGTFGNSGIRIRDFENMKRDDANPANYPYIVDTY<br>THYILENNKVEMFINDKEDSAPLLPVIEDDRYVVKTIPSCRMSTL<br>EIPAMAFHMLFLFGSKKTEKLIVDVHNRYKRLFQAMQKEEVTAE<br>NIASFGIAESDLPQKILDLISGNAHGKDVDAFIRLTVDDMLTDTE<br>RRIKRFKDDRKSIRSADNKMGKRGFKQISTGKLADFLAKDIVLF<br>QPSVNDGENKITGLNYRIMQSAIAVYDSGDDYEAKQQFKLMFE<br>KARLIGKGTTEPHPFLYKVFARSIPANAVEFYERYLIERKFYLTG<br>LSNEIKKGNRVDVPFIRRDQNKWKTPAMKTLGRIYSEDLPVELP<br>RQMFDNEIKSHLKSLPQMEGIDFNNANVTYLIAEYMKRVLDDD<br>FQTFYQWNRNYRYMDMLKGEYDRKGSLQHCFTSVEEREGLW<br>KERASRTERYRKQASNKIRSNRQMRNASSEEIETILDKRLSNSR<br>NEYQKSEKVIRRYRVQDALLFLLAKKTLTELADFDGERFKLKEI<br>MPDAEKGILSEIMPMSFTFEKGGKKYTITSEGMKLKNYGDFFVL<br>ASDKRIGNLLELVGSDIVSKEDIMEEFNKYDQCRPEISSIVFNLE<br>KWAFDTYPELSARVDREEKVDFKSILKILLNNKNINKEQSDILR<br>KIRNAFDHNNYPDKGVVEIKALPEIAMSIKKAFGEYAIMK<br>(SEQ ID NO: 53) |
| *Flavo-*<br>*bacterium*<br>*branchiophilum* | 16 | MENLNKILDKENEICISKIFNTKGIAAPITEKALDNIKSKQKNDL<br>NKEARLHYFSIGHSFKQIDTKKVFDYVLIEELKDEKPLKFITLQK<br>DFFTKEFSIKLQKLINSIRNINNHYVHNFNDINLNKIDSNVPHFLK<br>ESFELAIIEKYYKVNKKYPLDNEIVLFLKELFIKDENTALLNYFT<br>NLSKDEAIEYILTFTITENKIWNINNEHNILNIEKGKYLTFEAMLF<br>LITIFLYKNEANHLLPKLYDFKNNKSKQELFTFFSKKFTSQDIDA<br>EEGHLIKFRDMIQYLNHYPTAWNNDLKLESENKNKIMTTKLIDS<br>IIEFELNSNYPSFATDIQFKKEAKAFLFASNKKRNQTSFSNKSYN<br>EEIRHNPHIKQYRDEIASALTPISFNVKEDKFKIFVKKHVLEEYFP<br>NSIGYEKFLEYNDPTEKEKEDFGLKLYSNPKTNKLIERIDNHKL<br>VKSHGRNQDRFMDFSMRFLAENNYFGKDAFFKCYKFYDTQEQ<br>DEFLQSNENNDDVKFHKGKVTTYIKYEEHLKNYSYWDCPFVEE<br>NNSMSVKISIGSEEKILKIQRNLMIYFLENALYNENVENQGYKL<br>VNNYYRELKKDVEESIASLDIKSNPDFKSKYKKILPKRLLHNY<br>APAKQDKAPENAFETLLKKADFREEQYKKLLKKAEHEKNKED<br>FVKRNKGKQFKLHFIRKACQMMYFKEKYNTLKEGNAAFEKKD |

| | | |
|---|---|---|
| | | PVIEKRKNKEHEFGHHKNLNITREEFNDYCKWMFAFNGNDSYK<br>KYLRDLFSEKHFFDNQEYKNLFESSVNLEAFYAKTKELFKKWIE<br>TNKPTNNENRYTLENYKNLILQKQVFINVYHFSKYLIDKNLLNS<br>ENNVIQYKSLENVEYLISDFYFQSKLSIDQYKTCGKLFNKLKSN<br>KLEDCLLYEIAYNYIDKKNVHKIDIQKILTSKIILTINDANTPYKIS<br>VPFNKLERYTEMIAIKNQNNLKARFLIDLPLYLSKNKIKKGKDS<br>AGYEIIIKNDLEIEDINTINNKIIINDSVKFTEVLMELEKYFILKDKC<br>ILSKNYIDNSEIPSLKQFSKVWIKENENEIINYRNIACHFHLPLLET<br>FDNLLLNVEQKFIKEELQNVSTINDLSKPQEYLILLFIKFKHNNF<br>YLNLFNKNESKTIKNDKEVKKNRVLQKFINQVILKKK (SEQ ID NO: 54) |
| Myroides<br>odoratimimus | 17 | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSDIVIENKVLDFLNSSFVSTALHVKDKYLTDKTKE<br>FLKETIAAELDILIEAYKKKQIEKKNTRFKANKREDILNAIYNEA<br>FWSFINDKDKDKETVVAKGADAYFEKNHHKSNDPDFALNIS<br>EKGIVYLLSFFLTNKEMDSLKANLTGFKGKVDRESGNSIKYMA<br>TQRIYSFHTYRGLKQKIRTSEEGVKETLLMQMIDELSKVPNVVY<br>QHLSTTQQNSFIEDWNEYYKDYEDDVETDDLSRVTHPVIRKRY<br>EDRFNYFAIRFLDEFFDFPTLRFQVHLGDYVHDRRTKQLGKVES<br>DRIIKEKVTVFARLKDINSAKASYFHSLEEQDKEELDNKWTLFP<br>NPSYDFPKEHTLQHGEQKNAGKIGIYVKLRDTQYKEKAALEE<br>ARKSLNPKERSATKASKYDIITQIIEANDNVKSEKPLVFTGQPIA<br>YLSMNDIHSMLFSLLTDNAELKKTPEEVEAKLIDQIGKQINEILS<br>KDTDTKILKKYKDNDLKETDTDKITRDLARDKEEIEKLILEQKQ<br>RADDYNYTSSTKFNIDKSRKRKHLLFNAEKGKIGVWLANDIKR<br>FMFKESKSKWKGYQHIELQKLFAYFDTSKSDLELILSNMVMVK<br>DYPIELIDLVKKSRTLVDFLNKYLEARLEYIENVITRVKNSIGTP<br>QFKTVRKECFTFLKKSNYTVVSLDKQVERILSMPLFIERGFMDD<br>KPTMLEGKSYKQHKEKFADWFVHYKENSNYQNFYDTEVYEIT<br>TEDKREKAKVTKKIKQQQKNDVFTLMMVNYMLEEVLKLSSND<br>RLSLNELYQTKEERIVNKQVAKDTQERNKNYIWNKVVDLQLC<br>DGLVHIDNVKLKDIGNFRKYENDSRVKEFLTYQSDIVWSAYLS<br>NEVDSNKLYVIERQLDNYESIRSKELLKEVQEIECSVYNQVANK<br>ESLKQSGNENFKQYVLQGLLPIGMDVREMLILSTDVKFKKEEII<br>QLGQAGEVEQDLYSLIYIRNKFAHNQLPIKEFFDFCENNYRSISD<br>NEYYAEYYMEIFRSIKEKYAN (SEQ ID NO: 55) |
| Flavo-<br>bacterium<br>columnare | 18 | MSSKNESYNKQKTFNHYKQEDKYFFGGFLNNADDNLRQVGKE<br>FKTRINFNRNNNELASVFKDYFNKEKSVAKREHALNLLSNYFP<br>VLERIQKHTNHNFEQTREIFELLLDTIKKLRDYYTHHYHKPITIN<br>PKIYDFLDDTLLDVLITIKKKKVKNDTSRELLKEKLRPELTQLKN<br>QKREELIKKGKKLLEENLENAVFNHCLIPFLEENKTDDKQNKTV<br>SLRKYRKSKPNEETSITLTQSGLVFLMSFFLHRKEFQVFTSGLER<br>FKAKVNTIKEEEISLNKNNIVYMITHWSYSYYNFKGLKHRIKTD<br>QGVSTLEQNNTTHSLTNTNTKEALLTQIVDYLSKVPNEIYETLSE<br>KQQKEFEEDINEYMRENPENEDSTFSSIVSHKVIRKRYENKFNY<br>FAMRFLDEYAELPTLRFMVNFGDYIKDRQKKILESIQFDSERIIK<br>KEIHLFEKLSLVTEYKKNVYLKETSNIDLSRFPLFPNPSYVMAN<br>NNIPFYIDSRSNNLDEYLNQKKKAQSQNKKRNLTFEKYNKEQS<br>KDAIIAMLQKEIGVKDLQQRSTIGLLSCNELPSMLYEVIVKDIKG<br>AELENKIAQKIREQYQSIRDFTLDSPQKDNIPTTLIKTINTDSSVT<br>FENQPIDIPRLKNALQKELTLTQEKLLNVKEHEIEVDNYNRNKN<br>TYKFKNQPKNKVDDKKLQRKYVFYRNEIRQEANWLASDLIHF<br>MKNKSLWKGYMHNELQSFLAFFEDKKNDCIALLETVFNLKED<br>CILTKGLKNLFLKHGNFIDFYKEYLKLKEDFLSTESTFLENGFIG<br>LPPKILKKELSKRLKYIFIVFQKRQFIIKELEEKKNNLYADAINLS<br>RGIFDEKPTMIPFKKPNPDEFASWFVASYQYNNYQSFYELTPDI<br>VERDKKKKYKNLRAINKVKIQDYYLKLMVDTLYQDLFNQPLD<br>KSLSDFYVSKAEREKIKADAKAYQKLNDSSLWNKVIHLSLQNN<br>RITANPKLKDIGKYKRALQDEKIATLLTYDARTWTYALQKPEK<br>ENENDYKELHYTALNMELQEYEKVRSKELLKQVQELEKKILDK<br>FYDFSNNASHPEDLEIEDKKGKRHPNFKLYITKALLKNESEIINL<br>ENIDIEILLKYYDYNTEELKEKINMDEDEKAKIINTKENYNKIT<br>NVLIKKALVLIIRNKMAHNQYPPKFIYDLANRFVPKKEEEYFAT<br>YFNRVFETITKELWENKEKKDKTQV (SEQ ID NO: 56) |
| Porphyromonas<br>sp.<br>COT-052<br>OH4946 | 20 | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSESSELPLFDGNMLQRLYNV<br>FDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREDDRACFRVPVDILPDEDDTGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFVPEGQHLWPSPEVGTTRTGRSK |

|  |  | YAQDKRLTAEAFLSVHELMPMMFYYFLLREKYSEEVSAEKVQ |
|---|---|---|
|  |  | GRIKRVIEDVYAIYDAFARDEINTLKELDACLADKGIRRGHLPK |
|  |  | QMIGILSQERKDMEEKVRKKLQEMIADTDHRLDMLDRQTDRKI |
|  |  | RIGRKNAGLPKSGVIADWLVRDMMRFQPVAKDTSGKPLNNSK |
|  |  | ANSTEYRMLQRALALFGGEKERLTPYFRQMNLTGGNNPHPFLH |
|  |  | ETRWESHTNILSFYRSYLRARKAFLERIGRSDRVENCPFLLLKEP |
|  |  | KTDRQTLVAGWKGEFHLPRGIFTEAVRDCLIEMGYDEVGSYRE |
|  |  | VGFMAKAVPLYFERACEDRVQPFYDSPFNVGNSLKPKKGRFLS |
|  |  | KEDRAEEWERGKERFRDLEAWSHSAARRIKDAFAGIEYASPGN |
|  |  | KKKIEQLLRDLSLWEAFESKLKVRADKINLAKLKKEILEAQEHP |
|  |  | YHDPKSWQKFERELRLVKNQDIITWMMCRDLMEENKVEGLDT |
|  |  | GTLYLKDIRPNVQEQGSLNVLNRVKPMRLPVVVYRADSRGHV |
|  |  | HKEEAPLATVYIEERDTKLLKQGNFKSFVKDRRLNGLFSFVDTG |
|  |  | GLAMEQYPISKLRVEYELAKYQTARVCVFELTRLEESLLSRYP |
|  |  | HLPDESFREMLESWSDPLLAKWPELHGKVRLLIAVRNAFSHNQ |
|  |  | YPMYDEAVFSSIRKYDPSSPDAIEERMGLNIAHRLSEEVKQAKE |
|  |  | TVERIIQA (SEQ ID NO: 57) |
| Prevotella intermedia | 21 | MEDDKKTKESTNMLDNKHFWAAFLNLARHNVYITVNHINKVL |
|  |  | ELKNKKDQDIIIDNDQDILAIKTHWEKVNGDLNKTERLRELMTK |
|  |  | HFPPFLETAIYTKNKEDKEEVKQEKQAKAQSFDSLKHCLFLFLEK |
|  |  | LQEARNYYSHYKYSESTKEPMLEKELLKKMYNIFDDNIQLVIK |
|  |  | DYQHNKDINPDEDFKHLDRTEEEFNYYFTTNKKGNITASGLLFF |
|  |  | VSLFLEKKDAIWMQQKLRGFKDNRESKKKMTHEVFCRSRMLL |
|  |  | PKLRLESTQTQDWILLDMLNELIRCPKSLYERLQGEYRKKFNVP |
|  |  | FDSADEDYDAEQEPFKNTLVRHQDRFPYFALRYFDYNEIFTNLR |
|  |  | FQIDLGTYHFSIYKKLIGGQKEDRHLTHKLYGFERIQEFAKQNR |
|  |  | TDEWKAIVKDFDTYETSEEPYISETAPHYHLENQKIGIRFRNDN |
|  |  | DEIWPSLKTNGENNEKRKYKLDKQYQAEAFLSVHELLPMMFY |
|  |  | YLLLKKEEPNNDKKNASIVEGFIKREIRDIYKLYDAFANGEINNI |
|  |  | DDLEKYCEDKGIPKRHLPKQMVAILYDEHKDMAEEAKRKQKE |
|  |  | MVKDTKKLLATLEKQTQGEIEDGGRNIRLLKSGEIARWLVNDM |
|  |  | MRFQPVQKDNEGNPLNNSKANSTEYQMLQRSLALYNKEEKPT |
|  |  | RYFRQVNLINSSNPHPFLKWTKWEECNNILSFYRSYLTKKIEFLN |
|  |  | KLKPEDWEKNQYFLKLKEPKTNRETLVQGWKNGFNLPRGIFTE |
|  |  | PIREWFKRHQNDSEEYEKVETLDRVGLVTKVIPLFFKKEDSKDK |
|  |  | EEYLKKDAQKEINNCVQPFYGFPYNVGNIHKPDEKDFLPSEERK |
|  |  | KLWGDKKYKFKGYKAKVKSKKLTDKEKEEYRSYLEFQSWNK |
|  |  | FERELRLVRNQDIVTWLLCTELIDKLKVEGLNVEELKKLRLKDI |
|  |  | DTDTAKQEKNNILNRVMPMQLPVTVYEIDDSHNIVKDRPLHTV |
|  |  | YIEETKTKLLKQGNFKALVKDRRLNGLFSFVDTSSETELKSNPIS |
|  |  | KSLVEYELGEYQNARIETIKDMLLLEETLIEKYKTLPTDNFSDM |
|  |  | LNGWLEGKDEADKARFQNDVKLLVAVRNAFSHNQYPMRNRIA |
|  |  | FANINPFSLSSADTSEEKKLDIANQLKDKTHKIIKRIIEIEKPIETK |
|  |  | E (SEQ ID NO: 58) |
| PIN17_0200 [Prevotella intermedia 17] | AFJ07523 | MKMEDDKKTKESTNMLDNKHFWAAFLNLARHNVYITVNHIN |
|  |  | KVLELKNKKDQDIIIDNDQDILAIKTHWEKVNGDLNKTERLREL |
|  |  | MTKHFPPFLETAIYTKNKEDKEEVKQEKQAKAQSFDSLKHCLFL |
|  |  | FLEKLQEARNYYSHYKYSESTKEPMLEKELLKKMYNIFDDNIQ |
|  |  | LVIKDYQHNKDINPDEDFKHLDRTEEEFNYYFTTNKKGNITASG |
|  |  | LLFFVSLFLEKKDAIWMQQKLRGFKDNRESKKKMTHEVFCRSR |
|  |  | MLLPKLRLESTQTQDWILLDMLNELIRCPKSLYERLQGEYRKKF |
|  |  | NVPFDSADEDYDAEQEPFKNTLVRHQDRFPYFALRYFDYNEIFT |
|  |  | NLRFQIDLGTYHFSIYKKLIGGQKEDRHLTHKLYGFERIQEFAK |
|  |  | QNRTDEWKAIVKDFDTYETSEEPYISETAPHYHLENQKIGIRFRN |
|  |  | DNDEIWPSLKTNGENNEKRKYKLDKQYQAEAFLSVHELLPMM |
|  |  | FYYLLLKKEEPNNDKKNASIVEGFIKREIRDIYKLYDAFANGEIN |
|  |  | NIDDLEKYCEDKGIPKRHLPKQMVAILYDEHKDMAEEAKRKQ |
|  |  | KEMVKDTKKLLATLEKQTQGEIEDGGRNIRLLKSGEIARWLVN |
|  |  | DMMRFQPVQKDNEGNPLNNSKANSTEYQMLQRSLALYNKEEK |
|  |  | PTRYFRQVNLINSSNPHPFLKWTKWEECNNILSFYRSYLTKKIEF |
|  |  | LNKLKPEDWEKNQYFLKLKEPKTNRETLVQGWKNGFNLPRGIF |
|  |  | TEPIREWFKRHQNDSEEYEKVETLDRVGLVTKVIPLFFKKEDSK |
|  |  | DKEEYLKKDAQKEINNCVQPFYGFPYNVGNIHKPDEKDFLPSEE |
|  |  | RKKLWGDKKYKFKGYKAKVKSKKLTDKEKEEYRSYLEFQSW |
|  |  | NKFERELRLVRNQDIVTWLLCTELIDKLKVEGLNVEELKKLRLK |
|  |  | DIDTDTAKQEKNNILNRVMPMQLPVTVYEIDDSHNIVKDRPLHT |
|  |  | VYIEETKTKLLKQGNFKALVKDRRLNGLFSFVDTSSETELKSNPI |
|  |  | SKSLVEYELGEYQNARIETIKDMLLLEETLIEKYKTLPTDNFSDM |
|  |  | LNGWLEGKDEADKARFQNDVKLLVAVRNAFSHNQYPMRNRIA |
|  |  | FANINPFSLSSADTSEEKKLDIANQLKDKTHKIIKRBEIEKPIETK |
|  |  | E (SEQ ID NO: 59) |
| Prevotella intermedia | BAU18623 | MEDDKKTTDSISYELKDKHFWAAFLNLARHNVYITVNHINKVL |
|  |  | ELKNKKDQDIIIDNDQDILAIKTHWEKVNGDLNKTERLRELMTK |
|  |  | HFPPFLETAIYSKNKEDKEEVKQEKQAKAQSFDSLKHCLFLFLEK |
|  |  | LQETRNYYSHYKYSESTKEPMLEKELLKKMYNIFDDNIQLVIKD |
|  |  | YQHNKDINPDEDFKHLDRTEEDFNYYFTRNKKGNITESGLLFFV |

|  |  | SLFLEKKDAIWMQQKLRGFKDNRESKKKMTHEVFCRSRMLLP<br>KLRLESTQTQDWILLDMLNELIRCPKSLYERLQGEDREKFKVPF<br>DPADEDYDAEQEPPFKNTLVRHQDRFPYFALRYFDYNEIFTNLRF<br>QIDLGTFHFSIYKKLIGGQKEDRHLTHKLYGFERIQEFAKQNRPD<br>EWKAIVKDLDTYETSNERYISETTPHYHLENQKIGIRFRNDNDEI<br>WPSLKTNGENNEKSKYKLDKQYQAEAFLSVHELLPMMFYYLL<br>LKKEEPNNDKKNASIVEGFIKREIRDMYKLYDAFANGEINNIDD<br>LEKYCEDKGIPKRHLPKQMVAILYDEHKDMVKEAKRKQRKMV<br>KDTEKLLAALEKQTQEKTEDGGRNIRLLKSGEIARWLVNDMM<br>RFQPVQKDNEGNPLNNSKANSTEYQMLQRSLALYNKEEKPTRY<br>FRQVNLINSSNPHPFLKWTKWEECNNILSFYRSYLTKKIEFLNKL<br>KPEDWEKNQYFLKLKEPKTNRETLVQGWKNGFNLPRGIFTEPIR<br>EWFKRHQNDSKEYEKVEALDRVGLVTKVIPLFFKKEDSKDKEE<br>DLKKDAQKEINNCVQPFYSFPYNVGNIHKPDEKDFLHREERIEL<br>WDKKKDKFKGYKAKVKSKKLTDKEKEEYRSYLEFQSWNKFER<br>ELRLVRNQDIVTWLLCTELIDKLKVEGLNVEELKKLRLKDIDTD<br>TAKQEKNNILNRVMPMQLPVTVYEIDDSHNIVKDRPLHTVYIEE<br>TKTKLLKQGNFKALVKDRRLNGLFSFVDTSSEAELKSNPISKSL<br>VEYELGEYQNARIETIKDMLLLEETLIEKYKNLPTDNFSDMLNG<br>WLEGKDEADKARFQNDVKLLVAVRNAFSHNQYPMRNRIAFAN<br>INPFSLSSADTSEEKKLDIANQLKDTHKIIKRIIEIEKPIETKE<br>(SEQ ID NO: 60) |
| HMPREF6485_<br>0083<br>[*Prevotella<br>buccae*<br>ATCC<br>33574] | EFU31981 | MQKQDKLFVDRKKNAIFAFPKYITIMENKEKPEPIYYELTDKHF<br>WAAFLNLARHNVYTTINHINRRLEIAELKDDGYMMGIKGSWNE<br>QAKKLDKKVRLRDLIMKHFPPFLEAAAYEMTNSKSPNNKEQRE<br>KEQSEALSLNNLKNVLFIFLEKLQVLRNYYSHYKYSEESPKPIFE<br>TSLLKNMYKVFDANVRLVKRDYMHHENIDMQRDFTHLNRKK<br>QVGRTKNIIDSPNFHYHFADKEGNMTIAGLLFFVSLFLDKKDAI<br>WMQKKLKGFKDGRNLREQMTNEVFCRSRISLPKLKLENVQTK<br>DWMQLDMLNELVRCPKSLYERLREKDRESFKVPFDIFSDDYNA<br>EEEPFKNTLVRHQDRFPYFVLRYFDLNEIFEQLRFQIDLGTYHFS<br>IYNKRIGDEDEVRHLTHHLYGFARIQDFAPQNQPEEWRKLVKD<br>LDHFETSQEPYISKTAPHYHLENEKIGIKFCSAHNNLFPSLQTDK<br>TCNGRSKFNLGTQFTAEAFLSVHELLPMMFYYLLLTKDYSRKE<br>SADKVEGIIRKEISNIYAIYDAFANNEINSIADLTRRLQNTNILQG<br>HLPKQMISILKGRQKDMGKEAERKIGEMIDDTQRRLDLLCKQT<br>NQKIRIGKRNAGLLKSGKIADWLVNDMMRFQPVQKDQNNIPIN<br>NSKANSTEYRMLQRALALFGSENFRLKAYFNQMNLVGNDNPH<br>PPFLAETQWEHQTNILSFYRNYLEARKKYLKGLKPQNWKQYQH<br>FLILKVQKTNRNTLVTGWKNSFNLPRGIFTQPIREWFEKHNNSK<br>RIYDQILSFDRVGFVAKAIPLYFAEEYKDNVQPFYDYPFNIGNRL<br>KPKKRQFLDKKERVELWQKNKELFKNYPSEKKKTDLAYLDFLS<br>WKKFERELRLIKNQDIVTWLMFKELFNMATVEGLKIGEIHLRDI<br>DTNTANEESNNILNRIMPMKLPVKTYETDNKGNILKERPLATFY<br>IEETETKVLKQGNFKALVKDRRLNGLFSFAETTDLNLEEHPISKL<br>SVDLELIKYQTTRISIFEMTLGLEKKLIDKYSTLPTDSFRNMLER<br>WLQCKANRPELKNYVNSLIAVRNAFSHNQYPMYDATLFAEVK<br>KFTLFPSVDTKKIELNIAPQLLEIVGKAIKEIEKSENKN<br>(SEQ ID NO: 61) |
| HMPREF9144_<br>1146<br>[*Prevotella<br>pallens*<br>ATCC<br>700821] | EGQ18444 | MKEEEKGKTPVVSTYNKDDKHFWAAFLNLARHNVYITVNHIN<br>KILGEGEINRDGYENTLEKSWNEIKDINKKDRLSKLIIKHFPFLE<br>VTTYQRNSADTTKQKEEKQAEAQSLESLKKSFFVFIYKLRDLRN<br>HYSHYKHSKSLERPKFEEDLQEKMYNIFDASIQLVKEDYKHNT<br>DIKTEEDFKHLDRKGQFKYSFADNEGNITESGLLFFVSLFLEKK<br>DAIWVQKKLEGFKCSNESYQKMTNEVFCRSRMLLPKLRLQSTQ<br>TQDWILLDMLNELIRCPKSLYERLREEDRKKFRVPIEIADEDYD<br>AEQEPFKNALVRHQDRFPYFALRYFDYNEIFTNLRFQIDLGTYH<br>FSIYKKQIGDYKESHHLTHKLYGFERIQEFTKQNRPDEWRKFVK<br>TFNSFETSKEPYIPETTPHYHLENQKIGIRFRNDNDKIWPSLKTNS<br>EKNEKSKYKLDKSFQAEAFLSVHELLPMMFYYLLLKTENTDND<br>NEIETKKKENKNDKQEKHKIEEIIENKITEIYALYDAFANGKINSI<br>DKLEEYCKGKDIEIGHLPKQMIAILKSEHKDMATEAKRKQEEM<br>LADVQKSLESLDNQINEEIENVERKNSSLKSGEIASWLVNDMM<br>RFQPVQKDNEGNPLNNSKANSTEYQMLQRSLALYNKEEKPTRY<br>FRQVNLIESSNPHPFLNNTEWEKCNNILSFYRSYLEAKKNFLESL<br>KPEDWEKNQYFLMLKEPKTNCETLVQGWKNGFNLPRGIFTEPI<br>RKWFMEHRKNITVAELKRVGLVAKVIPLFFSEEYKDSVQPFYN<br>YLFNVGNINKPDEKNFLNCEERRELLRKKKDEFKKMTDKEKEE<br>NPSYLEFQSWNKFERELRLVRNQDIVTWLLCMELFNKKKIKEL<br>NVEKIYLKNINTNTTKKEKNTEEKNGEEKIIKEKNNILNRIMPMR<br>LPIKVYGRENFSKNKKKKIRRNTFFTVYIEEKGTKLLKQGNFKA<br>LERDRRLGGLFSFVKTHSKAESKSNTISKSRVEYELGEYQKARIE<br>IIKDMLALEETLIDKYNSLDTDNPHNMLTGWLKLKDEPDKASF<br>QNDVDLLIAVRNAFSHNQYPMRNRIAFANINPFSLSSANTSEEK<br>GLGIANQLKDTHKTIEKBEIEKPIETKE (SEQ ID NO: 62) |

-continued

| | | |
|---|---|---|
| HMPREF9714_02132 [*Myroides odoratimimus* CCUG 12901] | EHO08761 | MKDILTTDTTEKQNRFYSHKIADKYFFGGYFNLASNNIYEVFEE VNKRNTFGKLAKRDNGNLKNYIIHVFKDELSISDFEKRVAIFAS YFPILETVDKKSIKERNRTIDLTLSQRIRQFREMLISLVTAVDQLR NFYTHYHHSEIVIENKVLDFLNSSLVSTALHVKDKYLKTDKTKE FLKETIAAELDILIEAYKKKQIEKKNTRFKANKREDILNAIYNEA FWSFINDKDKDKETVVAKGADAYFEKNHHKSNDPDFALNISEK GIVYLLSFFLTNKEMDSLKANLTGFKGKVDRESGNSIKYMATQ RIYSFHTYRGLKQKIRTSEEGVKETLLMQMIDELSKVPNVVYQH LSTTQQNSFIEDWNEYYKDYEDDVETDDLSRVIHPVIRKRYEDR FNYFAIRFLDEFFDFPTLRFQVHLGDYVHDRRTKQLGKVESDRII KEKVTVFARLKDINSAKANYFHSLEEQDKEELDNKWTLFPNPS YDFPKEHTLQHQGEQKNAGKIGIYVKLRDTQYKEKAALEEARK SLNPKERSATKASKYDIITQIIEANDNVKSEKPLVFTGQPIAYLS MNDIHSMLFSLLTDNAELKKTPEEVEAKLIDQIGKQINEILSKDT DTKILKKYKDNDLKETDTDKITRDLARDKEEIEKLILEQKQRAD DYNYTSSTKFNIDKSRKRKHLLFNAEKGKIGVWLANDIKRFMT EEFKSKWKGYQHTELQKLFAYYDTSKSDLDLILSDMVMVKDY PIELIALVKKSRTLVDFLNKYLEARLGYMENVITRVKNSIGTPQF KTVRKECFTFLKKSNYTVVSLDKQVERILSNIPLFIERGFMDDKP TMLEGKSYQQHKEKFADWFVHYKENSNYQNFYDTEVYEITTE DKREKAKVTKKIKQQQKNDVFTLMMVNYMLEEVLKLSSNDRL SLNELYQTKEERIVNKQVAKDTQERNKNYIWNKVVDLQLCEG LVRIDKVKLKDIGNFRKYENDSRVKEFLTYQSDIVWSAYLSNEV DSNKLYVIERQLDNYESIRSKELLKEVQEIECSVYNQVANKESL KQSGNENFKQYVLQGLVPIGMDVREMLILSTDVKFIKEEIIQLG QAGEVEQDLYSLIYIRNKFAHNQLPIKEFFDFCENNYRSISDNEY YAEYYMEIFRSIKEKYTS (SEQ ID NO: 63) |
| HMPREF9711_00870 [*Myroides odoratimimus* CCUG 3837] | EKB06014 | MKDILTTDTTEKQNRFYSHKIADKYFFGGYFNLASNNIYEVFEE VNKRNTFGKLAKRDNGNLKNYIIHVFKDELSISDFEKRVAIFAS YFPILETVDKKSIKERNRTIDLTLSQRIRQFREMLISLVTAVDQLR NFYTHYHHSEIVIENKVLDFLNSSLVSTALHVKDKYLKTDKTKE FLKETIAAELDILIEAYKKKQIEKKNTRFKANKREDILNAIYNEA FWSFINDKDKDKETVVAKGADAYFEKNHHKSNDPDFALNISEK GIVYLLSFFLTNKEMDSLKANLTGFKGKVDRESGNSIKYMATQ RIYSFHTYRGLKQKIRTSEEGVKETLLMQMIDELSKVPNVVYQH LSTTQQNSFIEDWNEYYKDYEDDVETDDLSRVIHPVIRKRYEDR FNYFAIRFLDEFFDFPTLRFQVHLGDYVHDRRTKQLGKVESDRII KEKVTVFARLKDINSAKASYFHSLEEQDKEELDNKWTLFPNPS YDFPKEHTLQHQGEQKNAGKIGIYVKLRDTQYKEKAALEEARK SLNPKERSATKASKYDIITQIIEANDNVKSEKPLVFTGQPIAYLS MNDIHSMLFSLLTDNAELKKTPEEVEAKLIDQIGKQINEILSKDT DTKILKKYKDNDLKETDTDKITRDLARDKEEIEKLILEQKQRAD DYNYTSSTKFNIDKSRKRKHLLFNAEKGKIGVWLANDIKRFMF KESKSKWKGYQHTELQKLFAYFDTSKSDLELILSDMVMVKDYP IELIDLVRKSRTLVDFLNKYLEARLGYIENVITRVKNSIGTPQFKT VRKECFAFLKESNYTVASLDKQIERILSMPLFIERGFMDSKPTML EGKSYQQHKEDFADWFVHYKENSNYQNFYDTEVYEIITEDKRE QAKVTKKIKQQQKNDVFTLMMVNYMLEEVLKLPSNDRLSLNE LYQTKEERIVNKQVAKDTQERNKNYIWNKVVDLQLCEGLVRID KVKLKDIGNFRKYENDSRVKEFLTYQSDIVWSGYLSNEVDSNK LYVIERQLDNYESIRSKELLKEVQEIECIVYNQVANKESLKQSGN ENFKQYVLQGLLPRGTDVREMLILSTDVKFKKEEIMQLGQVRE VEQDLYSLIYIRNKFAHNQLPIKEFFDFCENNYRPISDNEYYAEY YMEIFRSIKEKYAS (SEQ ID NO: 64) |
| HMPREF9699_02005 [*Bergeyella zoohelcum* ATCC 43767] | EKB54193 | MENKTSLGNNIYYNPFKPQDKSYFAGYFNAAMENTDSVFRELG KRLKGKEYTSENFFDAIFKENISLVEYERYVKLLSDYFPMARLL DKKEVPIKERKENFKKNFKGIIKAVRDLRNFYTHKEHGEVEITD EIFGVLDEMLKSTVLTVKKKKVKTDKTKEILKKSIEKQLDILCQ KKLEYLRDTARKIEEKRRNQRERGEKELVAPFKYSDKRDDLIA AIYNDAFDVYIDKKKDSLKESSKAKYNTKSDPQQEEGDLKIPIS KNGVVFLLSLFLTKQEIHAFKSKIAGFKATVIDEATVSEATVSHG KNSICFMATHEIFSHLAYKKLKRKVRTAEINYGEAENAEQLSVY AKETLMMQMLDELSKVPDVVYQNLSEDVQKTFIEDWNEYLKE NNGDVGTMEEEQVIHPVIRKRYEDKFNYFAIRFLDEFAQFPTLR FQVEILGNYLHDSRPKENLISDRRIKEKITVFGRLSELEHKKALFI KNTETNEDREHYWEIFPNPNYDFPKENISVNDKDFPTAGSILDRE KQPVAGKIGIKVKLLNQQYVSEVDKAVKAHQLKQRKASKPSIQ NIIEEIVPINESNPKEAIVFGGQPTAYLSMNDIHSILYEFFDKWEK KKEKLEKKGEKELRKEIGKELEKKIVGKIQAQIQQIIDKDTNAKI LKPYQDGNSTAIDKEKLIKDLKQEQNILQKLKDEQTVREKEYN DFIAYQDKNREINKVRDNHQYLKDNLKRKYPEAPARKEVL YYREKGKVAVWLANDIKRFMPTDFKNEWKGEQHSLLQKSLAY YEQCKEELKNLLPEKVFQHLPFKLGGYFQQKYLYQFYTCYLDK RLEYISGLVQQAENFKSENKVFKKVENECFKFLKKQNYTHKEL DARVQSILGYPIFLERGFMDEKPTIIKGKTFKGNEALFADWFRY YKEYQNFQTFYDTENYPLVELEKKQADRKRKTKIYQQKKNDV FTLLMAKHIFKSVFKQDSIDQFSLEDLYQSREERLGNQERARQT |

| | | |
|---|---|---|
| | | GERNTNYIWNKTVDLKLCDGKITVENVKLKNVGDFIKYEYDQR VQAFLKYEENIEWQAFLIKESKEEENYPYVVEREIEQYEKVRRE ELLKEVHLIEEYILEKVKDKEILKKGDNQNFKYYILNGLLKQLK NEDVESYKVFNLNTEPEDVNINQLKQEATDLEQKAFVLTYIRN KFAHNQLPKKEFWDYCQEKYGKIEKEKTYAEYFAEVFKKEKE ALIK (SEQ ID NO: 65) |
| HMPREF9151_ 01387 [Prevotella saccharolytica F0055] | EKY00089 | MMEKENVQGSHIYYEPTDKCFWAAFYNLARHNAYLTIAHINSF VNSKKGINNDDKVLDIIDDWSKFDNDLLMGARLNKLILKHFPFL KAPLYQLAKRKTRKQQGKEQQDYEKKGDEDPEVIQEAIANAFK MANVRKTLHAFLKQLEDLRNHFSHYNYNSPAKKMEVKFDDGF CNKLYYVFDAALQMVKDDNRMNPEINMQTDFEHLVRLGRNR KIPNTFKYNFTNSDGTINNNGLLFFVSLFLEKRDAIWMQKKIKG FKGGTENYMRMTNEVFCRNRMVIPKLRLETDYDNHQLMFDML NELVRCPLSLYKRLKQEDQDKFRVPIEFLDEDNEADNPYQENA NSDENPTEETDPLKNTLVRHQHRFPYFVLRYFDLNEVFKQLRFQ INLGCYHFSIYDKTIGERTEKRHLTRTLFGFDRLQNFSVKLQPEH WKNMVKHLDTEESSDKPYLSDAMPHYQIENEKIGIHFLKTDTE KKETVWPSLEVEEVSSNRNKYKSEKNLTADAFLSTHELLPMMF YYQLLSSEEKTRAAAGDKVQGVLQSYRKKIFDIYDDFANGTINS MQKLDERLAKDNLLRGNMPQQMLAILEHQEPDMEQKAKEKL DRLITETKKRIGKLEDQFKQKVRIGKRRADLPKVGSIADWLVND MMRFQPAKRNADNTGVPDSKANSTEYRLLQEALAFYSAYKDR LEPYFRQVNLIGGTNPHPFLHRVDWKKCNHLLSFYHDYLEAKE QYLSHLSPADWQKHQHFLLLKVRKDIQNEKKDWKKSLVAGW KNGFNLPRGLFTESIKTWFSTDADKVQITDTKLFENRVGLIAKLI PLYYDKVYNDKPQPFYQYPFNINDRYKPEDTRKRFTAASSKLW NEKKMLYKNAQPDSSDKIEYPQYLDFLSWKKLERELRMLRNQ DMMVWLMCKDLFAQCTVEGVEFADLKLSQLEVDVNVQDNLN VLNNVSSMILPLSVYPSDAQGNVLRNSKPLHTVYVQENNTKLL KQGNFKSLLKDRRLNGLFSFIAAEGEDLQQHPLTKNRLEYELSI YQTMRISVFEQTLQLEKAILTRNKTLCGNNFNNLLNSWSEHRTD KKTLQPDIDFLIAVRNAFSHNQYPMSTNTVMQGIEKFNIQTPKL EEKDGLGIASQLAKKTKDAASRLQNIINGGTN (SEQ ID NO: 66) |
| A343_1752 [Porphyromonas gingivalis JCVI SC001] | EOA10535 | MTEQNEKPYNGTYYTLEDKHFWAAFFNLARHNAYITLTHIDRQ LAYSKADITNDEDILFFKGQWKNLDNDLERKARLRSLILKHFSF LEGAAYGKKLFESQSSGNKSSKKKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDRCGNNDN PFFKHHFVDREEKVTEAGLLFFVSLFLEKRDAIWMQKKIRGFKG GTETYQQMTNEVFCRSRISLPKLKLESLRTDDWMLLDMLNELV RCPKSLYDRLREEDRARFRVPVDILSDEDDTDGTEEDPFKNTLV RHQDRFPYFALRYFDLKKVFTSLRFHIDLGTYHFAIYKKNIGEQ PEDRHLTRNLYGFGRIQDFAEEHRPEEWKRLVRDLDYFETGDK PYITQTTPHYHIEKGKIGLRFVPEGQLLWPSPEVGATRTGRSKY AQDKRFTAEAFLSVHELMPMMFYYFLLREKYSEEASAERVQGR IKRVIEDVYAVYDAFARGEIDTLDRLDACLADKGIRRGHLPRQ MIAILSQEHKDMEEKVRKKLQEMIADTDHRLDMLDRQTDRKIR IGRKNAGLPKSGVIADWLVRDMMRFQPVAKDTSGKPLNNSKA NSTEYRMLQRALALFGGEKERLTPYFRQMNLTGGNNPHPFLHE TRWESHTNILSFYRSYLKARKAFLQSIGRSDRVENHRFLLLKEP KTDRQTLVAGWKGEFHLPRGIFTEAVRDCLIEMGLDEVGSYKE VGFMAKAVPLYFERACKDRVQPFYDYPFNVGNSLKPKKGRFLS KEKRAEEWESGKERFRDLEAWSHSAARRIEDAFAGIENASREN KKKIEQLLQDLSLWETFESKLKVKADKINIAKLKKEILEAKEHP YLDPKSWQKFERELRLVKNQDIITWMIVICRDLMEENKVEGLDT GTLYLKDIRTDVHEQGSLNVLNRVKPMRLPVVVYRADSRGHV HKEQAPLATVYIEERDTKLLKQGNFKSFVKDRRLNGLFSFVDT GALAMEQYPISKLRVEYELAKYQTARVCAFEQTLELEESLLTRY PHLPDKNFRKMLESWSDPLLDKWPDLHGNVRLLIAVRNAFSHN QYPMYDETLFSSIRKYDPSSPDAIEERMGLNIAHRLSEEVKQAK EMVERIIQA (SEQ ID NO: 67) |
| HMPREF1981_ 03090 [Bacteroides pyogenes F0041] | ERI81700 | MESIKNSQKSTGKTLQKDPPYFGLYLNMALLNVRKVENHIRKW LGDVALLPEKSGFHSLLTTDNLSSAKWTRFYYKSRKFLPPLEMF DSDKKSYENRRETTECLDTIDRQKISSLLKEVYGKLQDIRNAFS HYHIDDQSVKHTALIISSEMHRFIENAYSFALQKTRAPFTGVFVE TDFLQAEEKGDNKKFFAIGGNEGIKLKDNALIFLICLFLDREEAF KFLSRATGFKSTKEKGFLAVRETFCALCCRQPHERLLSVNPREA LLMDMLNELNRCPDILFEMLDEKDQKSFLPLLGEEEQAHILENS LNDELCEAIDDPFEMIASLSKRVRYKNRFPYLMLRYIEEKNLLPF IRFRIDLGCLELASYPKKMGEENNYERSVTDHAMAFGRLTDFH NEDAVLQQITKGITDEVRFSLYAPRYAIYNNKIGFVRTGGSDKIS FPTLKKKGGEGHCVAYTLQNTKSFGFISIYDLRKILLLSFLDKDK AKNIVSGLLEQCEKHWKDLSENLFDAIRTELQKEFPVPLIRYTLP RSKGGKLVSSKLADKQEKYESEFERRKEKLTEILSEKDFDLSQIP RRMIDEWLNVLPTSREKKLKGYVETLKLDCRERLRVFEKREKG EHPVPPRIGEMATDLAKDIIRMVIDQGVKQRITSAYYSEIQRCLA |

| | | |
|---|---|---|
| | | QYAGDDNRRHLDSIIRELRLKDTKNGHPFLGKVLRPGLGHTEK<br>LYQRYFEEKKEWLEATFYPAASPKRVPRFVNPPTGKQKELPLII<br>RNLMKERPEWRDWKQRKNSHPIDLPSQLFENEICRLLKDIGKE<br>PSGKLKWNEMFKLYWDKEFPNGMQRFYRCKRRVEVFDKVVE<br>YEYSEEGGNYKKYYEALIDEVVRQKISSSKEKSKLQVEDLTLSV<br>RRVFKRAINEKEYQLRLLCEDDRLLFMAVRDLYDWKEAQLDL<br>DKIDNMLGEPVSVSQVIQLEGGQPDAVIKAECKLKDVSKLMRY<br>CYDGRVKGLMPYFANHEATQEQVEMELRHYEDHRRRVFNWV<br>FALEKSVLKNEKLRRFYEESQGGCEHRRCIDALRKASLVSEEEY<br>EFLVHIRNKSAHNQFPDLEIGKLPPNVTSGFCECIWSKYKAIICRI<br>IPFIDPERRFFGKLLEQK (SEQ ID NO: 68) |
| HMPREF1553_<br>02065<br>[*Porphyromonas<br>gingivalis*<br>F0568] | ERJ65637 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPPLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL<br>(SEQ ID NO: 69) |
| HMPREF1988_<br>01768<br>[*Porphyromonas<br>gingivalis*<br>F0185] | ERJ81987 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDEIDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRQFRAIV<br>AELHLLDPSSGHPPLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIIVIELLKVDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL<br>(SEQ ID NO: 70) |
| HMPREF1990_<br>01800<br>[*Porphyromonas<br>gingivalis*<br>W4087] | ERJ87335 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDEIDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR |

| | | |
|---|---|---|
| | | ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIFIGKSVSYIPSDGKKFADCYTHL<br>MEKTVRDKKRELRTAGKPVPPDLAAYIKRSFHRAVNEREFMLR<br>LVQEDDRLMLMAINKIMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEIPLIYRDVSAKVGSIEGSSAKDLPEG<br>SSLVDSLWKKYEMIIRKILPILDPENRFFGKLLNNMSQPINDL<br>(SEQ ID NO: 71) |
| M573_<br>117042<br>[Prevotella<br>intermedia<br>ZT] | KJJ86756 | MKMEDDKKTTESTNMLDNKHFWAAFLNLARHNVYITVNHINK<br>VLELKNKKDQDIIIDNDQDILAIKTHWEKVNGDLNKTERLRELM<br>TKHFPFLETAIYTKNKEDKEEVKQEKQAEAQSLESLKDCLFLFL<br>EKLQEARNYYSHYKYSESTKEPMLEEGLLEKMYNIFDDNIQLVI<br>KDYQHNKDINPDEDFKHLDRKGQFKYSFADNEGNITESGLLFF<br>VSLFLEKKDAIWMQQKLTGFKDNRESKKKMTHEVFCRRRMLL<br>PKLRLESTQTQDWILLDMLNELIRCPKSLYERLQGEYRKKFNVP<br>FDSADEDYDAEQEPFKNTLVRHQDRFPYFALRYFDYNEIFTNLR<br>FQIDLGTYHFSIYKKLIGGQKEDRHLTHKLYGFERIQEFAKQNRP<br>DEWKALVKDLDTYETSNERYISETTPHYHLENQKIGIRFRNGNK<br>EIWPSLKTNGENNEKSKYKLDKPYQAEAFLSVHELLPMMFYYL<br>LLKKEEPNNDKKNASIVEGFIKREIRDMYKLYDAFANGEINNIG<br>DLEKYCEDKGIPKRHLPKQMVAILYDEPKDMVKEAKRKQKEM<br>VKDTKKLLATLEKQTQEEIEDGGRNIRLLKSGEIARWLVNDMM<br>RFQPVQKDNEGNPLNNSKANSTEYQMLQRSLALYNKEEKPTRY<br>FRQVNLINSSNPHPFLKWTKWEECNNILSFYRNYLTKKIEFLNK<br>LKPEDWEKNQYFLKLKEPKTNRETLVQGWKNGFNLPRGIFTEPI<br>REWFKRHQNDSKEYEKVEALKRVGLVTKVIPLFFKEEYFKEDA<br>QKEINNCVQPFYSFPYNVGNIHKPDEKDFLPSEERKKLWGDKK<br>DKFKGYKAKVKSKKLTDKEKEEYRSYLEFQSWNKFERELRLV<br>RNQDIVTWLLCTELIDKMKVEGLNVEELQKLRLKDIDTDTAKQ<br>EKNNILNRIMPMQLPVTVYEIDDSHNIVKDRPLHTVYIEETKTKL<br>LKQGNFKALVKDRRLNGLFSFVDTSSKAELKDKPISKSVVEYEL<br>GEYQNARIETIKDMLLLEKTLIKKYEKLPTDNFSDMLNGWLEG<br>KDESDKARFQNDVKLLVAVRNAFSHNQYPMRNRIAFANINPFS<br>LSSADISEEKKLDIANQLKDKTHKIIKKIIEIEKPIETKE<br>(SEQ ID NO: 72) |
| Prevotella<br>buccae | WP_<br>004343581 | MQKQDKLFVDRKKNAIFAFPKYITIMENQEKPEPIYYELTDKHF<br>WAAFLNLARHNVYTTINHINRRLEIAELKDDGSWNE<br>QAKKLDKKVRLRDLIMKHFPPFLEAAAYEITNSKSPNNKEQREK<br>EQSEALSLNNLKNVLFIFLEKLQVLRNYYSHYKYSEESPKPIFET<br>SLLKNMYKVFDANVRLVKRDYMHHENIDMQRDFTHLNRKKQ<br>VGRTKNIIDSPNFHYHFADKEGNMTIAGLLFFVSLFLDKKDAIW<br>MQKKLKGFKDGRNLREQMTNEVFCRSRISLPKLKLENVQTKD<br>WMQLDMLNELVRCPKSLYERLREKDRESFKVPFDIFSDDYDAE<br>EEPFKNTLVRHQDRFPYFVLRYFDLNEIFEQLRFQIDLGTYHFSI<br>YNKRIGDEDEVRHLTHHLYGFARIQDFAQQNQPEVWRKLVKD<br>LDYFEASQEPYIPKTAPHYHLENEKIGIKFCSTHNNLFPSLKTEK<br>TCNGRSKFNLGTQPFTAEAFLSVHELLPMMFYYLLLTKDYSRKE<br>SADKVEGIIRKEISNIYAIYDAFANGEINSIADLTCRLQKTNILQG<br>HLPKQMISILEGRQKDMEKEAERKIGEMIDDTQRRLDLLCKQTN<br>QKIRIGKRNAGLLKSGKIADWLVNDMMRFQPVQKDQNNIPINN<br>SKANSTEYRMLQRALALFGSENFRLKAYFNQMNLVGNDNPHP<br>FLAETQWEHQTNILSFYRNYLEARKKYLKGLKPQNWKQYHF<br>LILKVQKTNRNTLVTGWKNSFNLPRGIFTQPIREWFEKHNNSKR<br>IYDQILSFDRVGFVAKAIPLYFAEEYKDNVQPFYDYPFNIGNKL<br>KPQKGQFLDKKERVELWQKNKELFKNYPSEKKKTDLAYLDFL<br>SWKKFERELRLIKNQDIVTWLMFKELFNMATVEGLKIGEIHLRD<br>IDTNTANEESNNILNRIMPMKLPVKTYETDNKGNILKERPLATF<br>YIEETETKVLKQGNFKVLAKDRRLNGLLSFAETTDIDLEKNPITK<br>LSVDHELIKYQTTRISIFEMTLGLEKKLINKYPTLPTDSFRNMLE<br>RWLQCKANRPELKNYVNSLIAVRNAFSHNQYPMYDATLFAEV<br>KKFTLFPSVDTKKIELNIAPQLLEIVGKAIKEIEKSENKN<br>(SEQ ID NO: 73) |
| Porphyromonas<br>gingivalis | WP_<br>005873511 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE |

| | | |
|---|---|---|
| | | LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTIITDHALAFGKLSDFQNEEEVSR<br>MISGEASYPVRFSLFAPRYAIYDNKIGYCHTSDPVYPKSKTGEK<br>RALSNPQSMGFISVHNLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL<br>(SEQ ID NO: 74) |
| Porphyromonas<br>gingivalis | WP_<br>005874195 | MTEQNEKPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDKYGNNDN<br>PFFKHHFVDREEKVTEAGLLFFVSLFLEKRDAIWMQKKIRGFKG<br>GTEAYQQMTNEVFCRSRISLPKLKLESLRTDDWMLLDMLNELV<br>RCPKSLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQLLWPSPEVGATRTGRSKY<br>AQDKRFTAEAFLSVHELMPMMFYYFLLREKYSEEASASAEKVQG<br>RIKRVIEDVYAVYDAFARDEINTRDELDACLADKGIRRGHLPRQ<br>MIAILSQEHKDMEEKVRKKLQEMIADTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDREENHRFLLLKEPK<br>TDRQTLVAGWKSEFHLPRGIFTEAVRDCLIEMGYDEVGSYKEV<br>GFMAKAVPLYFERACKDRVQPFYDYPFNVGNSLKPKKGRFLSK<br>EKRAEEWESGKERFRDLEAWSHSAARRIEDAFVGIEYASWENK<br>KKIEQLLQDLSLWETFESKLKVKADKINIAKLKKEILEAKEHPY<br>HDFKSWQKFERELRLVKNQDIITWMMCRDLMEEENKVEGLDTG<br>TLYLKDIRTDVQEQGSLNVLNHVKPMRLPVVVYRADSRGHVH<br>KEEAPLATVYIEERDTKLLKQGNFKSFVKDRRLNGLFSFVDTGA<br>LAMEQYPISKLRVEYELAKYQTARVCAFEQTLELEESLLTRYPH<br>LPDESFREMLESWSDPLLDKWPDLQREVRLLIAVRNAFSHNQY<br>PMYDETIFSSIRKYDPSSLDAIEERMGLNIAHRLSEEVKLAKEMV<br>ERIIQA (SEQ ID NO: 75) |
| Prevotella<br>pallens | WP_<br>006044833 | MKEEEKGKTPVVSTYNKDDKHFWAAFLNLARHNVYITVNHIN<br>KILGEGEINRDGYENTLEKSWNEIKDINKKDRLSKLIIKHFPFLE<br>VTTYQRNSADTTKQKEEKQAEAQSLESLKKSFFVFIYKLRDLRN<br>HYSHYKHSKSLERPKFEEDLQEKMYNIFDASIQLVKEDYKHNT<br>DIKTEEDFKHLDRKGQFKYSFADNEGNITESGLLFFVSLFLEKK<br>DAIWVQKKLEGFKCSNESYQKMTNEVFCRSRMLLPKLRLQSTQ<br>TQDWILLDMLNELIRCPKSLYERLREEDRKKFRVPIEIADEDYD<br>AEQEPFKNALVRHQDRFPYFALRYFDYNEIFTNLRFQIDLGTYH<br>FSIYKKQIGDYKESHHLTHKLYGFERIQEFTKQNRPDEWRKFVK<br>TFNSFETSKEPYIPETTPHYHLENQKIGIRFRNDNDKIWPSLKTNS<br>EKNEKSKYKLDKSFQAEAFLSVHELLPMMFYYLLLKTENTDND<br>NEIETKKKENKNDKQEKHKIEEIIENKITEIYALYDAFANGKINSI<br>DKLEEYCKGKDIEIGHLPKQMIAILKSEHKDMATEAKRKQEEM<br>LADVQKSLESLDNQINEEIENVERKNSSLKSGEIASWLVNDMM<br>RFQPVQKDNEGNPLNNSKANSTEYQMLRSLALYNKEEKPTRY<br>FRQVNLIESSNPHPFLNNTEWEKCNNILSFYRSYLEAKKNFLESL<br>KPEDWEKNQYFLMLKEPKTNCETLVQGWKNGFNLPRGIFTEPI<br>RKWFMEHRKNITVAELKRVGLVAKVIPLFFSEEYKDSVQPFYN<br>YLFNVGNINKPDEKNFLNCEERRELLRKKKDEFKKMTDKEKEE<br>NPSYLEFQSWNKFERELRLVRNQDIVTWLLCMELFNKKKIKEL<br>NVEKIYLKNINTNTTKKEKNTEEKNGEEKIIKEKNNILNRIMPMR<br>LPIKVYGRENFSKNKKKKIRRNTFFTVYIEEKGTKLLKQGNFKA<br>LERDRRLGGLFSFVKTHSKAESKSNTISKSRVEYELGEYQKARIE<br>IIKDMLALEETLIDKYNSLDTDNPHNMLTGWLKLKDEPDKASF<br>QNDVDLLIAVRNAFSHNQYPMRNRIAFANINPFSLSSANTSEEK<br>GLGIANQLKDKTHKTIEKIIEIEKPIETKE (SEQ ID NO: 76) |

| | | |
|---|---|---|
| Myroides odoratimimus | WP_006261414 | MKDILTTDTTEKQNRFYSHKIADKYFFGGYFNLASNNIYEVFEE VNKRNTFGKLAKRDNGNLKNYIIHVFKDELSISDFEKRVAIFAS YFPILETVDKKSIKERNRTIDLTLSQRIRQFREMLISLVTAVDQLR NFYTHYHHSEIVIENKVLDFLNSSLVSTALHVKDKYLKTDKTKE FLKETIAAELDILIEAYKKKQIEKKNTRFKANKREDILNAIYNEA FWSFINDKDKDKETVVAKGADAYFEKNHHKSNDPDFALNISEK GIVYLLSFFLTNKEMDSLKANLTGFKGKVDRESGNSIKYMATQ RIYSFHTYRGLKQKIRTSEEGVKETLLMQMIDELSKVPNVVYQH LSTTQQNSFIEDWNEYYKDYEDDVETDDLSRVIHPVIRKRYEDR FNYFAIRFLDEFFDFPTLRFQVHLGDYVHDRRTKQLGKVESDRII KEKVTVFARLKDINSAKANYFHSLEEQDKEELDNKWTLFPNPS YDFPKEHTLQHQGEQKNAGKIGIYVKLRDTQYKEKAALEEARK SLNPKERSATKASKYDIITQIIEANDNVKSEKPLVFTGQPIAYLS MNDIHSMLFSLLTDNAELKKTPEEVEAKLIDQIGKQINEILSKDT DTKILKKYKDNDLKETDTDKITRDLARDKEEIEKLILEQKQRAD DYNYTSSTKFNIDKSRKRKHLLFNAEKGKIGVWLANDIKRFMT EEFKSKWKGYQHTELQKLFAYYDTSKSDLDLILSDMVMVKDY PIELIALVKKSRTLVDFLNKYLEARLGYMENVITRVKNSIGTPQF KTVRKECFTFLKKSNYTVVSLDKQVERILSMPLFIERGFMDDKP TMLEGKSYQQHKEKFADWFVHYKENSNYQNFYDTEVYEITTE DKREKAKVTKKIKQQQKNDVFTLMMVNYMLEEVLKLSSNDRL SLNELYQTKEERIVNKQVAKDTQERNKNYIWNKVVDLQLCEG LVRIDKVKLKDIGNFRKYENDSRVKEFLTYQSDIVWSAYLSNEV DSNKLYVIERQLDNYESIRSKELLKEVQEIECSVYNQVANKESL KQSGNENFKQYVLQGLVPIGMDVREMLILSTDVKFIKEEIIQLG QAGEVEQDLYSLIYIRNKFAHNQLPIKEFFDFCENNYRSISDNEY YAEYYMEIFRSIKEKYTS (SEQ ID NO: 77) |
| Myroides odoratimimus | WP_006265509 | MKDILTTDTTEKQNRFYSHKIADKYFFGGYFNLASNNIYEVFEE VNKRNTFGKLAKRDNGNLKNYIIHVFKDELSISDFEKRVAIFAS YFPILETVDKKSIKERNRTIDLTLSQRIRQFREMLISLVTAVDQLR NFYTHYHHSEIVIENKVLDFLNSSLVSTALHVKDKYLKTDKTKE FLKETIAAELDILIEAYKKKQIEKKNTRFKANKREDILNAIYNEA FWSFINDKDKDKETVVAKGADAYFEKNHHKSNDPDFALNISEK GIVYLLSFFLTNKEMDSLKANLTGFKGKVDRESGNSIKYMATQ RIYSFHTYRGLKQKIRTSEEGVKETLLMQMIDELSKVPNVVYQH LSTTQQNSFIEDWNEYYKDYEDDVETDDLSRVIHPVIRKRYEDR FNYFAIRFLDEFFDFPTLRFQVEILGDYVHDRRTKQLGKVESDRII KEKVTVFARLKDINSAKASYFHSLEEQDKEELDNKWTLFPNPS YDFPKEHTLQHQGEQKNAGKIGIYVKLRDTQYKEKAALEEARK SLNPKERSATKASKYDIITQIIEANDNVKSEKPLVFTGQPIAYLS MNDIHSMLFSLLTDNAELKKTPEEVEAKLIDQIGKQINEILSKDT DTKILKKYKDNDLKETDTDKITRDLARDKEEIEKLILEQKQRAD DYNYTSSTKFNIDKSRKRKHLLFNAEKGKIGVWLANDIKRFMF KESKSKWKGYQHTELQKLFAYFDTSKSDLELILSDMVMVKDYP IELIDLVRKSRTLVDFLNKYLEARLGYIENVITRVKNSIGTPQFKT VRKECFAFLKESNYTVASLDKQIERILSMPLFIERGFMDSKPTML EGKSYQQHKEDFADWFVHYKENSNYQNFYDTEVYEIITEDKRE QAKVTKKIKQQQKNDVFTLMMVNYMLEEVLKLPSNDRLSLNE LYQTKEERIVNKQVAKDTQERNKNYIWNKVVDLQLCEGLVRID KVKLKDIGNFRKYENDSRVKEFLTYQSDIVWSGYLSNEVDSNK LYVIERQLDNYESIRSKELLKEVQEIECIVYNQVANKESLKQSGN ENFKQYVLQGLLPRGTDVREMLILSTDVKFKKEEIMQLGQVRE VEQDLYSLIYIRNKFAHNQLPIKEFFDFCENNYRPISDNEYYAEY YMEIFRSIKEKYAS (SEQ ID NO: 78) |
| Prevotella sp. MSX73 | WP_007412163 | MQKQDKLFVDRKKNAIFAFPKYITIMENQEKPEPIYYELTDKHF WAAFLNLARHNVYTTINHINRRLEIAELKDDGYMMGIKGSWNE QAKKLDKKVRLRDLIMKHFPFLEAAAYEITNSKSPNNKEQREK EQSEALSLNNLKNVLFIFLEKLQVLRNYYSHYKYSEESPKPIFET SLLKNMYKVFDANVRLVKRDYMHHENIDMQRDFTHLNRKKQ VGRTKNIIDSPNFHYHFADKEGNMTIAGLLFFVSLFLDKKDAIW MQKKLKGFKDGRNLREQMTNEVFCRSRISLPKLKLENVQTKD WMQLDMLNELVRCPKSLYERLREKDRESFKVPFDIFSDDYDAE EEPFKNTLVRHQDRFPYFVLRYFDLNEIFEQLRFQIDLGTYHFSI YNKRIGDEDEVRHLTHHLYGFARIQDFAPQNQPEEWRKLVKDL DHFETSQEPYISKTAPHYHLENEKIGIKFCSTHNNLFPSLKREKT CNGRSKFNLGTQFTAEAFLSVHELLPMMFYYLLLTKDYSRKES ADKVEGIIRKEISNIYAIYDAFANNEINSIADLTCRLQKTNILQGH LPKQMISILEGRQKDMEKEAERKIGEMIDDTQRRLDLLCKQTNQ KIRIGKRNAGLLKSGKIADWLVSDMMRFQPVQKDTNNAPINNS KANSTEYRMLQHALALFGSESSRLKAYFRQMNLVGNANPHPFL AETQWEHQTNILSFYRNYLEARKKYLKGLKPQNWKQYQHFLIL KVQKTNRNTLVTGWKNSFNLPRGIFTQPIREWFEKHNNSKRIYD QILSFDRVGFVAKAIPLYFAEEYKDNVQPFYDYPFNIGNKLKPQ KGQPFLDKKERVELWQKNKELFKNYPSEKNKTDLAYLDFLSWK KFERELRLIKNQDIVTWLMFKELFKTTTVEGLKIGEIHLRDIDTN TANEESNNILNREVIPMKLPVKTYETDNKGNILKERPLATFYIEET ETKVLKQGNFKVLAKDRRLNGLLSFAETTDIDLEKNPITKLSVD |

| | | |
|---|---|---|
| | | YELIKYQTTRISIFEMTLGLEKKLIDKYSTLPTDSFRNMLERWLQ CKANRPELKNYVNSLIAVRNAFSHNQYPMYDATLFAEVKKFTL FPSVDTKKIELNIAPQLLEIVGKAIKEIEKSENKN (SEQ ID NO: 79) |
| *Porphyromonas gingivalis* | WP_ 012458414 | MTEQNERPYNGTYYTLEDKHFWAAFFNLARHNAYITLAHIDRQ LAYSKADITNDEDILFFKGQWKNLDNDLERKARLRSLILKHFSF LEGAAYGKKLFESQSSGNKSSKKKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDRYGNNDN PFFKHHFVDREEKVTEAGLLFFVSLFLEKRDAIWMQKKIRGFKG GTETYQQMTNEVFCRSRISLPKLKLESLRTDDWMLLDMLNELV RCPKSLYDRLREEDRARFRVPVDILSDEDDTDGTEEDPFKNTLV RHQDRFPYFALRYFDLKKVFTSLRFHIDLGTYHFAIYKKNIGEQ PEDRHLTRNLYGFGRIQDFAEEHRPEEWKRLVRDLDYFETGDK PYITQTTPHYHIEKGKIGLRFVPEGQHLWPSPEVGATRTGRSKY AQDKRLTAEAFLSVHELMPMMFYYFLLREKYSDEASAERVQG RIKRVIEDVYAVYDAFARGEINTRDELDACLADKGIRRGHLPRQ MIGILSQEHKDMEEKVRKKLQEMIVDTDHRLDMLDRQTDRKIR IGRKNAGLPKSGVIADWLVRDMMRFQPVAKDTSGKPLNNSKA NSTEYRMLQRALALFGGEKERLTPYFRQMNLTGGNNPHPFLHE TRWESHTNILSFYRSYLKARKAFLQSIGRSDRVENHRFLLLKEP KTDRQTLVAGWKGEFHLPRGIFTEAVRDCLIEMGLDEVGSYKE VGFMAKAVPLYFERACKDRVQPFYDYPFNVGNSLKPKKGRFLS KEKRAEEWESGKERFRLAKLKKEILEAKEHPYLDFKSWQKFER ELRLVKNQDIITWMICRDLMEENKVEGLDTGTLYLKDIRTDVQ EQGNLNVLNRVKPMRLPVVVYRADSRGHVHKEQAPLATVYIE ERDTKLLKQGNFKSFVKDRRLNGLFSFVDTGALAMEQYPISKL RVEYELAKYQTARVCAFEQTLELEESLLTRYPHLPDKNFRKML ESWSDPLLDKWPDLHGNVRLLIAVRNAFSHNQYPMYDEAVFSS IRKYDPSSPDAIEERMGLNIAHRLSEEVKQAKEMAERIIQA (SEQ ID NO: 80) |
| *Paludibacter propionici- genes* | WP_ 013446107 | MKTSANNIYFNGINSFKKIFDSKGAIAPIAEKSCRNFDIKAQNDV NKEQRIHYFAVGHTFKQLDTENLFEYVLDENLRAKRPTRFISLQ QFDKEFIENIKRLISDIRNINSHYIHRFDPLKIDAVPTNIIDFLKESF ELAVIQIYLKEKGINYLQFSENPHADQKLVAFLHDKFLPLDEKK TSMLQNETPQLKEYKEYRKYFKTLSKQAAIDQLLFAEKETDYI WNLFDSHPVLTISAGKYLSFYSCLFLLSMFLYKSEANQLISKIKG FKKNTTEEEKSKREIFTFFSKRFNSMDIDSEENQLVKFRDLILYL NHYPVAWNKDLELDSSNPAMTDKLKSKIIELEINRSFPLYEGNE RFATFAKYQIWGKKHLGKSIEKEYINASFTDEEITAYTYETDTCP ELKDAHKKLADLKAAKGLFGKRKEKNESDIKKTETSIRELQHEP NPIKDKLIQRIEKNLLTVSYGRNQDRFMDFSARFLAEINYFGQD ASFKMYHFYATDEQNSELEKYELPKDKKKYDSLKFHQGKLVH FISYKEHLKRYESWDDAFVIENNAIQLKLSFDGVENTVTIQRAL LIYLLEDALRNIQNNTAENAGKQLLQEYYSHNKADLSAFKQILT QQDSIEPQQKTEFKKLLPRRLLNNYSPAINHLQTPHSSLPLILEK ALLAEKRYCSLVVKAKAEGNYDDFIKRNKGKQFKLQFIRKAW NLMYFRNSYLQNVQAAGHHKSFHIERDEFNDFSRYMFAFEELS QYKYYLNEMFEKKGFFENNEFKILFQSGTSLENLYEKTKQKFEI WLASNTAKTNKPDNYHLNNYEQQFSNQLFFINLSHFINYLKSTG KLQTDANGQIIYEALNNVQYLIPEYYYTDKPERSESKSGNKLYN KLKATKLEDALLYEMAMCYLKADKQIADKAKHPITKLLTSDVE FNITNKEGIQLYHLLVPFKKIDAFIGLKMHKEQQDKKHPTSFLA NIVNYLELVKNDKDIRKTYEAFSTNPVKRTLTYDDLAKIDGHLI SKSIKFTNVTLELERYFIFKESLIVKKGNNIDFKYIKGLRNYYNN EKKKNEGIRNKAFHFGIPDSKSYDQLIRDAEVMFIANEVKPTHA TKYTDLNKQLHTVCDKLMETVHNDYFSKEGDGKKKREAAGQ KYFENIISAK (SEQ ID NO: 81) |
| *Porphyromonas gingivalis* | WP_ 013816155 | MTEQNEKPYNGTYYTLEDKHFWAAFFNLARHNAYITLAHIDRQ LAYSKADITNDEDILFFKGQWKNLDNDLERKARLRSLILKHFSF LEGAAYGKKLFESQSSGNKSSKNKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDRYGNNDN PFFKHHFVDREGTVTEAGLLFFVSLFLEKRDAIWMQKKIRGFKG GTETYQQMTNEVFCRSRISLPKLKLESLRTDDWMLLDMLNELV RCPKSLYDRLREEDRARFRVPVDILSDEEDTDGAEEDPFKNTLV RHQDRFPYFALRYFDLKKVFTSLRFQIDLGTYHFAIYKKNIGEQ PEDRHLTRNLYGFGRIQDFAEEHRPEEWKRLVRDLDYFETGDK PYITQTTPHYHIEKGKIGLRFVPEGQHLWPSPEVGATRTGRSKY AQDKRFTAEAFLSAHELMPMMFYYFLLREKYSEEASAERVQGR IKRVIEDVYAVYDAFARDEINTRDELDACLADKGIRRGHLPRQ MIGILSQEHKDMEEKIRKKLQEMMADTDHRLDMLDRQTDRKIR IGRKNAGLPKSGVIADWLVRDMMRFQPVAKDTSGKPLNNSKA NSTEYRMLQRALALFGGEKERLTPYFRQMNLTGGNNPHPFLHE TRWESHTNILSFYRSYLKARKAFLQSIGRSDRVENHRFLLLKEP KTDRQTLVAGWKGEFHLPRGIFTEAVRDCLIEMGLDEVGSYKE VGFMAKAVPLYFERACKDWVQPFYNYPFNVGNSLKPKKGRFL |

-continued

|  |  |  |
|---|---|---|
|  |  | SKEKRAEEWESGKERFRLAKLKKEILEAKEHPYLDFKSWQKFE<br>RELRLVKNQDIITWMICGDLMEENKVEGLDTGTLYLKDIRTDV<br>QEQGSLNVLNRVKPMRLPVVVYRADSRGHVHKEQAPLATVYI<br>EERDTKLLKQGNFKSFVKDRRLNGLFSFVDTGALAMEQYPISK<br>LRVEYELAKYQTARVCAFEQTLELEESLLTRCPHLPDKNFRKM<br>LESWSDPLLDKWPDLHRKVRLLIAVRNAFSHNQYPMYDEAVFS<br>SIRKYDPSFPDAIEERMGLNIAHRLSEEVKQAKETVERIIQA<br>(SEQ ID NO: 82) |
| *Flavo-<br>bacterium<br>columnare* | WP_<br>014165541 | MSSKNESYNKQKTFNHYKQEDKYFFGGFLNNADDNLRQVGKE<br>FKTRINFNHNNNELASVFKDYFNKEKSVAKREHALNLLSNYFP<br>VLERIQKHTNHNFEQTREIFELLLDTIKKLRDYYTHHYHKPITIN<br>PKIYDFLDDTLLDVLITIKKKKVKNDTSRELLKEKLRPELTQLKN<br>QKREELIKKGKKLLEENLENAVFNHCLRPFLEENKTDDKQNKT<br>VSLRKYRKSKPNEETSITLTQSGLVFLMSFFLHRKEFQVFTSGLE<br>GFKAKVNTIKEEEISLNKNNIVYMITHWSYSYYNFKGLKHRIKT<br>DQGVSTLEQNNTTHSLTNTNTKEALLTQIVDYLSKVPNEIYETL<br>SEKQQKEFEEDINEYMRENPENEDSTFSSIVSHKVIRKRYENKFN<br>YFAMRFLDEYAELPTLRFMVNFGDYIKDRQKKILESIQFDSERII<br>KKEIHLFEKLSLVTEYKKNVYLKETSNIDLSRFPLFPNPSYVMA<br>NNNIPFYIDSRSNNLDEYLNQKKKAQSQNKKRNLTFEKYNKEQ<br>SKDAIIAMLQKEIGVKDLQQRSTIGLLSCNELPSMLYEVIVKDIK<br>GAELENKIAQKIREQYQSIRDFTLDSPQKDNIPTTLIKTINTDSSV<br>TFENQPIDIPRLKNAIQKELTLTQEKLLNVKEHEIEVDNYNRNKN<br>TYKFKNQPKNKVDDKKLQRKYVFYRNEIRQEANWLASDLIHF<br>MKNKSLWKGYMHNELQSFLAFFEDKKNDCIALLETVFNLKED<br>CILTKGLKNLFLKHGNFIDFYKEYLKLKEDFLNTESTFLENGLIG<br>LPPKILKKELSKRFKYIFIVFQKRQFIIKELEEKKNNLYADAINLS<br>RGIFDEKPTMIPFKKPNPDEFASWFVASYQYNNYQSFYELTPDI<br>VERDKKKKYKNLRAINKVKIQDYYLKLMVDTLYQDLFNQPLD<br>KSLSDFYVSKAEREKIKADAKAYQKRNDSSLWNKVIHLSLQNN<br>RITANPKLKDIGKYKRALQDEKIATLLTYDDRTWTYALQKPEK<br>ENENDYKELHYTALNMELQEYEKVRSKELLKQVQELEKQILEE<br>YTDFLSTQIHPADFEREGNPNFKKYLAHSILENEDDLDKLPEKV<br>EAMRELDETITNPIIKKAIVLIIIRNKMAHNQYPPKFIYDLANRFV<br>PKKEEEYFATYFNRVFETITKELWENKEKKDKTQV (SEQ ID NO: 83) |
| *Psychroflexus<br>torquis* | WP_<br>501024765 | MESIIGLGLSFNPYKTADKHYFGSFLNLVENNLNAVFAEFKERIS<br>YKAKDENISSLIEKHFIDNMSIVDYEKKISILNGYLPIIDFLDDELE<br>NNLNTRVKNFKKNFIILAEAIEKLRDYYTHFYHDPITFEDNKEPL<br>LELLDEVLLKTILDVKKKYLKTDKTKEILKDSLREEMDLLVIRK<br>TDELREKKKTNPKIQHTDSSQIKNSIFNDAFQGLLYEDKGNNKK<br>TQVSHRAKTRLNPKDIHKQEERDFEIPLSTSGLVFLMSLFLSKKE<br>IEDPKSNIKGFKGKVVKDENHNSLKYMATHRVYSILAFKGLKY<br>RIKTDTFSKETLMMQMIDELSKVPDCVYQNLSETKQKDFIEDW<br>NEYFKDNEENTENLENSRVVHPVIRKRYEDKFNYFAIRFLDEFA<br>NFKTLKFQVFMGYYIHDQRTKTIGTTNITTERTVKEKINVFGKL<br>SKMDNLKKHFFSQLSDDENTDWEFFPNPSYNFLTQADNSPANN<br>IPIYLELKNQQIIKEKDAIKAEVNQTQNRNPNKPSKRDLLNKILK<br>TYEDFHQGDPTAILSLNEIPALLHLFLVKPNNKTGQQIENIIRIKIE<br>KQFKAINHPSKNNKGIPKSLFADTNVRVNAIKLKKDLEAELDM<br>LNKKHIAFKENQKASSNYDKLLKEHQFTPKNKRPELRKYVFYK<br>SEKGEEATWLANDIKRFMPKDFKTKWKGCQHSELQRKLAFYD<br>RHTKQDIKELLSGCEFDHSLLDINAYFQKDNFEDFFSKYLENRIE<br>TLEGVLKKLHDFKNEPTPLKGVFKNCFKFLKRQNYVTESPEIIK<br>KRILAKPTFLPRGVFDERPTMKKGKNPLKDKNEFAEWFVEYLE<br>NKDYQKFYNAEEYRMRDADFKKNAVIKKQKLKDFYTLQMVN<br>YLLKEVFGKDEMNLQLSELFQTRQERLKLQGIAKKQMNKETG<br>DSSENTRNQTYIWNKDVPVSFFNGKVTIDKVKLKNIGKYKRYE<br>RDERVKTFIGYEVDEKWMMYLPHNWKDRYSVKPINVIDLQIQE<br>YEEIRSHELLKEIQNLEQYIYDHTTDKNILLQDGNPNFKMYVLN<br>GLLIGIKQVNIPDFIVLKQNTNFDKIDFTGIASCSELEKKTIILIAIR<br>NKFAHNQLPNKMIYDLANEFLKIEKNETYANYYLKVLKKMISD<br>LA (SEQ ID NO: 84) |
| *Riemerella<br>anatipestifer* | WP_<br>015345620 | MFFSFHNAQRVIFKHLYKAFDASLRMVKEDYKAHFTVNLTRDF<br>AHLNRKGKNKQDNPDFNRYRFEKDGFFTESGLLFFTNLFLDKR<br>DAYWMLKKVSGFKASHKQREKMTTEVFCRSRILLPKLRESRY<br>DHNQMLLDMLSELSRCPKLLYEKLSEENKKHFQVEADGFLDEI<br>EEEQNPFKDTLIRHQDRFPYFALRYLDLNESFKSIRFQVDLGTYH<br>YCIYDKKIGDEQEKRHLTRTLLSFGRLQDFTEINRPQEWKALTK<br>DLDYKETSNQPFISKTTPHYHITDNKIGFRLGTSKELYPSLEIKDG<br>ANRIAKYPYNSGFVAHAFISVHELLPLMFYQHLTGKSEDLLKET<br>VRHIQRIYKDFEEERINTIEDLEKANQGRLPLGAFPKQMLGLLQ<br>NKQPDLSEKAKIKIEKLIAETKLLSHRLNTKLKSSPKLGKRREKL<br>IKTGVLADWLVKDFMRFQPVAYDAQNQPIKSSKANSTEFWFIR<br>RALALYGGEKNRLEGYFKQTNLIGNTNPHPFLNKFNWKACRNL<br>VDFYQQYLEQREKFLEAIKHQPWEPYQYCLLLKVPKENRKNLV<br>KGWEQGGISLPRGLFTEAIRETLSKDLTLSKPIRKEIKKHGRVGFI |

| | | |
|---|---|---|
| | | SRAITLYFKEKYQDKHQSFYNLSYKLEAKAPLLKKEEHYEYWQ<br>QNKPQSPTESQRLELHTSDRWKDYLLYKRWQHLEKKLRLYRN<br>QDIMLWLMTLELTKNHFKELNLNYHQLKLENLAVNVQEADAK<br>LNPLNQTLPMVLPVKVYPTTAFGEVQYHETPIRTVYIREEQTKA<br>LKMGNFKALVKDRRLNGLFSFIKEENDTQKHPISQLRLRRELEI<br>YQSLRVDAFKETLSLEEKLLNKHASLSSLENEFRTLLEEWKKKY<br>AASSMVTDKHIAFIASVRNAFCHNQYPFYKETLHAPILLFTVAQ<br>PTTEEKDGLGIAEALLKVLREYCEIVKSQI (SEQ ID NO: 85) |
| *Prevotella pleuritidis* | WP_<br>021584635 | MENDKRLEESACYTLNDKHFWAAFLNLARHNVYITVNHINKTL<br>ELKNKKNQEIIIDNDQDILAIKTHWAKVNGDLNKTDRLRELMIK<br>HFPPFLEAAIYSNNKEDKEEVKEEKQAKAQSFKSLKDCLFLFLEK<br>LQEARNYYSHYKYSESSKEPEFEEGLLEKMYNTFDASIRLVKED<br>YQYNKDIDPEKDFKHLERKEDFNYLFTDKDNKGKITKNGLLFF<br>VSLFLEKKDAIWMQQKFRGFKDNRGNKEKMTHEVFCRSRMLL<br>PKIRLESTQTQDWILLDMLNELIRCPKSLYERLQGAYREKFKVP<br>FDSIDEDYDAEQEPFRNTLVRHQDRFPYFALRYFDYNEIFKNLR<br>FQIDLGTYHFSIYKKLIGGKKEDRHLTHKLYGFERIQEFTKQNRP<br>DKWQAIIKDLDTYETSNERYISETTPHYHLENQKIGIRFRNDNN<br>DIWPSLKTNGEKNEKSKYNLDKPYQAEAFLSVHELLPMMFYYL<br>LLKMENTDNDKEDNEVGTKKKGNKNNKQEKHKIEEIIENKIKDI<br>YALYDAFTNGEINSIDELAEQREGKDIEIGHLPKQLIVILKNKSK<br>DMAEKANRKQKEMIKDTKKRLATLDKQVKGEIEDGGRNIRLL<br>KSGEIARWLVNDMMRFQPVQKDNEGKPLNNSKANSTEYQMLQ<br>RSLALYNKEEKPTRYFRQVNLIKSSNPHPFLEDTKWEECYNILSF<br>YRNYLKAKIKFLNKLKPEDWKKNQYFLMLKEPKTNRKTLVQG<br>WKNGFNLPRGIFTEPIKEWFKRHQNDSEEYKKVEALDRVGLVA<br>KVIPLFFKEEYFKEDAQKEINNCVQPFYSFPYNVGNIHKPEEKNF<br>LHCEERRKLWDKKKDKFKGYKAKEKSKKMTDKEKEEHRSYLE<br>FQSWNKFERELRLVRNQDILTWLLCTKLIDKLKIDELNIEELQKL<br>RLKDIDTDTAKKEKNNILNRVMPMRLPVTVYEIDKSFNIVKDKP<br>LHTVYIEETGTKLLKQGNFKALVKDRRLNGLFSVKTSSEAESK<br>SKPISKLRVEYELGAYQKARIDIIKDMLALEKTLIDNDENLPTNK<br>FSDMLKSWLKGKGEANKARLQNDVGLLVAVRNAFSHNQYPM<br>YNSEVFKGMKLLSLSSDIPEKEGLGIAKQLKDKIKETIERIIEIEKE<br>IRN (SEQ ID NO: 86) |
| *Porphyromonas gingivalis* | WP_<br>021663197 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL<br>(SEQ ID NO: 87) |
| *Porphyromonas gingivalis* | WP_<br>021665475 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTNENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLRKFRKDGDGKARAIPLVGEMATFLS |

| | | |
|---|---|---|
| | | QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL<br>(SEQ ID NO: 88) |
| Porphyromonas<br>gingivalis | WP_<br>021677657 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL<br>(SEQ ID NO: 89) |
| Porphyromonas<br>gingivalis | WP_<br>021680012 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDEIDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIFIGKSVSYIPSDGKKFADCYTHL<br>MEKTVRDKKRELRTAGKPVPPDLAAYIKRSFHRAVNEREFMLR<br>LVQEDDRLMLMAINKIMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEIPLIYRDVSAKVGSIEGSSAKDLPEG<br>SSLVDSLWKKYEMIIRKILPILDPENRFFGKLLNNMSQPINDL<br>(SEQ ID NO: 90) |
| Porphyromonas<br>gingivalis | WP_<br>023846767 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDEIDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR |

| | | |
|---|---|---|
| | | MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRNIKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL<br>(SEQ ID NO: 91) |
| *Prevotella*<br>*falsenii* | WP_<br>036884929 | MKNDNNSTKSTDYTLGDKHFWAAFLNLARHNVYITVNHINKV<br>LELKNKKDQEIIIDNDQDILAIKTLWGKVDTDINKKDRLRELIM<br>KHFPFLEAATYQQSSTNNTKQEEEQAKAQSFESLKDCLFLFLE<br>KLREARNYYSHYKHSKSLEEPKLEEKLLENMYNIFDTNVQLVIK<br>DYEHNKDINPEEDFKHLGRAEGEFNYYFTRNKKGNITESGLLFF<br>VSLFLEKKDAIWAQTKIKGFKDNRENKQKMTHEVFCRSRMLLP<br>KLRLESTQTQDWILLDMLNELIRCPKSLYKRLQGEKREKFRVPF<br>DPADEDYDAEQEPPFKNTLVRHQDRFPYFALRYFDYNEIFTNLRF<br>QIDLGTYHFSIYKKQIGDKKEDRHLTHKLYGFERIQEFAKENRP<br>DEWKALVKDLDTFEESNEPYISETTPHYHLENQKIGIRNKNKKK<br>KKTIWPSLETKTTVNERSKYNLGKSFKAEAFLSVHELLPMMFY<br>YLLLNKEEPNNGKINASKVEGIIEKKIRDIYKLYGAFANEEINNE<br>EELKEYCEGKDIAIRHLPKQMIAILKNEYKDMAKKAEDKQKKM<br>IKDTKKRLAALDKQVKGEVEDGGRNIKPLKSGRIASWLVNDM<br>MRFQPVQRDRDGYPLNNSKANSTEYQLLQRTLALFGSERERLA<br>PYFRQMNLIGKDNPHPFLKDTKWKEHNNILSFYRSYLEAKKNF<br>LGSLKPEDWKKNQYFLKLKEPKTNRETLVQGWKNGFNLPRGIF<br>TEPIREWFIRHQNESEEYKKVKDFDRIGLVAKVIPLFFKEDYQKE<br>IEDYVQPFYGYPFNVGNIHNSQEGTFLNKKEREELWKGNKTKF<br>KDYKTKEKNKEKTNKDKFKKKTDEEKEEFRSYLDFQSWKKFE<br>RELRLVRNQDIVTWLLCMELIDKLKIDELNIEELQKLRLKDIDTD<br>TAKKEKNNILNRIMPMELPVTVYETDDSNNIIKDKPLHTIYIKEA<br>ETKLLKQGNFKALVKDRRLNGLFSFVETSSEAELKSKPISKSLVE<br>YELGEYQRARVEIIKDMLRLEETLIGNDEKLPTNKFRQMLDKW<br>LEHKKETDDTDLKNDVKLLTEVRNAFSHNQYPMRDRIAFANIK<br>PFSLSSANTSNEEGLGIAKKLKDKTKETIDRIIEIEEQTATKR<br>(SEQ ID NO: 92) |
| *Prevotella*<br>*pleuritidis* | WP_<br>036931485 | MENDKRLEESTCYTLNDKHFWAAFLNLARHNVYITINHINKLL<br>EIRQIDNDEKVLDIKALWQKVDKDINQKARLRELMIKHPFFLEA<br>AIYSNNKEDKEEVKEEKQAKAQSFKSLKDCLFLFLEKLQEARN<br>YYSHYKSSESSKEPEFEEGLLEKMYNTFGVSIRLVKEDYQYNKD<br>IDPEKDFKHLERKEDFNYLFTDKDNKGKITKNGLLFFVSLFLEK<br>KDAIWMQQKLRGFKDNRGNKEKMTHEVFCRSRMLLPKIRLES<br>TQTQDWILLDMLNELIRCPKSLYERLQGAYREKFKVPFDSIDED<br>YDAEQEPFRNTLVRHQDRFPYFALRYFDYNEIFKNLRFQIDLGT<br>YHFSIYKKLIGDNKEDRHLTHKLYGFERIQEFAKQKRPNEWQA<br>LVKDLDIYETSNEQYISETTPHYHLENQKIGIRFKNKKDKIWPSL<br>ETNGKENEKSKYNLDKSFQAEAFLSIHELLPMMFYDLLLLKKEEP<br>NNDEKNASIVEGFIKKEIKRMYAIYDAFANEEINSKEGLEEYCK<br>NKGFQERHLPKQMIAILTNKSKNMAEKAKRKQKEMIKDTKKR<br>LATLDKQVKGEIEDGGRNIRLLKSGEIARWLVNDMMRFQSVQK<br>DKEGKPLNNSKANSTEYQMLQRSLALYNKEQKPTPYFIQVNLI<br>KSSNPHPFLEETKWEECNNILSFYRSYLEAKKNFLESLKPEDWK<br>KNQYFLMLKEPKTNRKTLVQGWKNGFNLPRGIFTEPIKEWFKR<br>HQNDSEEYKKVEALDRVGLVAKVIPLFFKEEYFKEDAQKEINN<br>CVQPFYSFPYNVGNIHKPEEKNFLHCEERRKLWDKKKDKFKGY<br>KAKEKSKKMTDKEKEEHRSYLEFQSWNKFERELRLVRNQDIVT<br>WLLCTELIDKLKIDELNIEELQKLRLKDIDTDTAKKEKNNILNRI<br>MPMQLPVTVYEIDKSFNIVKDKPLHTIYIEETGTKLLKQGNFKA<br>LVKDRRLNGLFSFVKTSSEAESKSKPISKLRVEYELGAYQKARI<br>DIIKDMLALEKTLIDNDENLPTNKFSDMLKSWLKGKGEANKAR<br>LQNDVDLLVAIRNAFSHNQYPMYNSEVFKGMKLLSLSSDIPEKE<br>GLGIAKQLKDKIKETIERIIEIEKEIRN (SEQ ID NO: 93) |
| [*Porphyromonas*<br>*gingivalis* | WP_<br>039417390 | MTEQNERPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRYGNNDN |

| | | |
|---|---|---|
| | | PFFKHHFVDREGTVTEAGLLFFVSLFLEKRDAIWMQKKIRGFKG<br>GTEAYQQMTNEVFCRSRISLPKLKLESLRTDDWMLLDMLNELV<br>RCPKSLYDRLREEDRARFRVPIDILSDEDDTDGTEEDPFKNTLVR<br>HQDRFPYFALRYFDLKKVFTSLRFHIDLGTYHFAIYKKNIGEQPE<br>DRHLTRNLYGFGRIQDFAEEHRPEEWKRLVRDLDYFETGDKPY<br>ITQTTPHYHIEKGKIGLRFVPEGQHLWPSPEVGATRTGRSKYAQ<br>DKRLTAEAFLSVHELMPMMFYYFLLREKYSEEVSAEKVQGRIK<br>RVIEDVYAVYDAFARGEIDTLDRLDACLADKGIRRGHLPRQMI<br>AILSQEHKDMEEKVRKKLQEMIADTDHRLDMLDRQTDRKIRIG<br>RKNAGLPKSGVIADWLVRDMMRFQPVAKDTSGKPLNNSKANS<br>TEYRMLQRALALFGGEKERLTPYFRQMNLTGGNNPHPFLHETR<br>WESHTNILSFYRSYLKARKAFLQSIGRSDREENHRFLLLKEPKT<br>DRQTLVAGWKSEFHLPRGIFTEAVRDCLIEMGYDEVGSYKEVG<br>FMAKAVPLYFERACKDRVQPFYDYPFNVGNSLKPKKGRFLSKE<br>KRAEEWESGKERFRLAKLKKEILEAKEHPYLDFKSWQKFEREL<br>RLVKNQDIITWMMCRDLMEENKVEGLDTGTLYLKDIRTDVHE<br>QGSLNVLNRVKPMRLPVVVYRADSRGHVHKEQAPLATVYIEE<br>RDTKLLKQGNFKSFVKDRRLNGLFSFVDTGALAMEQYPISKLR<br>VEYELAKYQTARVCAFEQTLELEESLLTRYPHLPDKNFRKMLE<br>SWSDPLLDKWPDLHRKVRLLIAVRNAFSHNQYPMYDEAVFSSI<br>RKYDPSSPDAIEERMGLNIAHRLSEEVKQAKEMAERIIQV<br>(SEQ ID NO: 94) |
| Porphyromonas<br>gulae | WP_<br>039418912 | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRMDDWMLLDMLNE<br>LVRCPKPLYDRLREDDRACFRVPVDILPDEDDTDGGGEDPFKN<br>TLVRHQDRFPYFALRYFDLKKVFTSLRFHIDLGTYHFAIYKKMI<br>GEQPEDRHLTRNLYGFGRIQDFAEEHRPEEWKRLVRDLDYFET<br>GDKPYISQTSPHYHIEKGKIGLRFMPEGQHLWPSPEVGTTRTGR<br>SKYAQDKRLTAEAFLSVHELMPMMFYYFLLREKYSEEVSAEKV<br>QGRIKRVIEDVYAIYDAFARDEINTLKELDACLADKGIRRGHLP<br>KQMIAILSQEHKNMEEKVRKKLQEMIADTDHRLDMLDRQTDR<br>KIRIGRKNAGLPKSGVIADWLVRDMMRFQPVAKDASGKPLNNS<br>KANSTEYRMLQRALALFGGEKERLTPYFRQMNLTGGNNPHPFL<br>HDTRWESHTNILSFYRSYLRARKAFLERIGRSDRMENRPFLLLK<br>EPKTDRQTLVAGWKSEFHLPRGIFTEAVRDCLIEMGYDEVGSY<br>REVGFMAKAVPLYFERACEDRVQPFYDSPFNVGNSLKPKKGRF<br>LSKEERAEEWERGKERFRDLEAWSHSAARRIEDAFAGIEYASPG<br>NKKKIEQLLRDLSLWEAFESKLKVRADKINLAKLKKEILEAQEH<br>PYHDFKSWQKFERELRLVKNQDIITWMMCRDLMEENKVEGLD<br>TGTLYLKDIRTNVQEQGSLNVLNHVKPMRLPVVVYRADSRGH<br>VHKEEAPLATVYIEERDTKLLKQGNFKSFVKDRRLNGLFSFVDT<br>GGLAMEQYPISKLRVEYELAKYQTARVCAFEQTLELEESLLTRY<br>PHLPDKNFRKMLESWSDPLLAKWPELHGKVRLLIAVRNAFSHN<br>QYPMYDEAVFSSIRKYDPSSPDAIEERMGLNIAHRLSEEVKQAK<br>ETVERIIQA (SEQ ID NO: 95) |
| Porphyromonas<br>gulae | WP_<br>039419792 | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHRHFNHLVRKGKKDRYGHNDN<br>PSFKHHFVDGEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREKDRARFRVPVDILPDEDDTDGGGEDPFKNT<br>LVRHQDRFPYFALRYFDLKKVFTSLRFHIDLGTYHFAIYKKVIG<br>EQPEDRHLTRNLYGFGRIQDFAEEHRPEEWKRLVRDLDYFETG<br>DKPYISQTTPHYHIEKGKIGLRFVPEGQHLWPSPEVGTTRTGRSK<br>YAQDKRLTAEAFLSVHELMPMMFYYFLLREKYSEEVSAEKVQ<br>GRIKRVIEDVYAIYDAFARDEINTRDELDACLADKGIRRGHLPK<br>QMIGILSQEHKNMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLD<br>ETRWESHTNILSFYRSYLRARKAFLERIGRSDRVENRPFLLLKEP<br>KTDRQTLVAGWKSEFHLPRGIFTEAVRDCLIEMGYDEVGSYKE<br>VGFMAKAVPLYFERACKDRVQPFYDSPFNVGNSLKPKKGRFLS<br>KEKRAEEWESGKERFRLAKLKKEILEAQEHPYHDFKSWQKFER<br>ELRLVKNQDIITWMMCRDLMEENKVEGLDTGTLYLKDIRPNVQ<br>EQGSLNVLNRVKPMRLPVVVYRADSRGHVHKEEAPLATVYIEE<br>RDTKLLKQGNFKSFVKDRRLNGLFSFVDTGGLAMEQYPISKLR<br>VEYELAKYQTARVCVFELTLRLEESLLSRYPHLPDESFREMLES<br>WSDPLLAKWPELHGKVRLLIAVRNAFSHNQYPMYDEAVFSSIR<br>KYDPSSPDAIEERMGLNIAHRLSEEVKQAKETVERIIQA<br>(SEQ ID NO: 96) |

| | | |
|---|---|---|
| *Porphyromonas gulae* | WP_039426176 | MTEQSERPYNGTYYTLEDKHFWAAFLNLARHNAYITLTHIDRQ
LAYSKADITNDQDVLSFKALWKNFDNDLERKSRLRSLILKHFSF
LEGAAYGKKLFESKSSGNKSSKNKELTKKEKEELQANALSLDN
LKSILFDFLQKLKDFRNYYSHYRHSGSSELPLFDGNMLQRLYNV
FDVSVQRVKRDHEHNDKVDPHYHFNHLVRKGKKDRYGHNDN
PSFKHHFVDSEGMVTEAGLLFFVSLFLEKRDAIWMQKKIRGFK
GGTGPYEQMTNEVFCRSRISLPKLKLESLRTDDWMLLDMLNEL
VRCPKPLYDRLREKDRACFRVPVDILPDEDDTDGGGEDPFKNT
LVRHQDRFPYFALRYFDLKKVFTSLRFHIDLGTYHFAIYKKMIG
EQPEDRHLTRNLYGFGRIQDFAEEHRPEEWKRLVRDLDYFETG
DKPYISQTTPHYHIEKGKIGLRFMPEGQHLWPSPEVGTTRTGRS
KYAQDKRLTAEAFLSVHELMPMMFYYFLLREKYSEEVSAEKV
QGRIKRVIKDVYAIYDAFARDEINTLKELDACSADKGIRRGHLP
KQMIGILSQEHKNMEEKVRKKLQEMIADTDHRLDMLDRQTDR
KIRIGRKNAGLPKSGVIADWLVRDMMRFQPVAKDTSGKPLNNS
KANSTEYRMLQRALALFGGEKERLTPYFRQMNLTGGNNPHPFL
DETRWESHTNILSFYRSYLRARKAFLERIGRSDRVENRPFLLLKE
PKNDRQTLVAGWKSEFHLPRGIFTEAVRDCLIEMGYDEVGSYK
EVGFMAKAVPLYFERACKDRVQPFYDSPFNVGNSLKPKKGRFL
SKEKRAEEWESGKERFRLAKLKKEILEAKEHPYHDFKSWQKFE
RELRLVKNQDIITWMMCRDLMEENKVEGLDTGTLYLKDIRTDV
HEQGSLNVLNRVKPMRLPVVVYRADSRGHVHKEQAPLATVYI
EERDTKLLKQGNFKSFVKDRRLNGLFSFVDTGGLAMEQYPISK
LRVEYELAKYQTARVCAFEQTLELEESLLTRYPHLPDENFREML
ESWSDPLLGKWPDLHGKVRLLIAVRNAFSHNQYPMYDEAVFSS
IRKYDPSSPDAIEERMGLNIAHRLSEEVKQAKETVERIIQA
(SEQ ID NO: 97) |
| *Porphyromonas gulae* | WP_039431778 | MTEQSERPYNGTYYTLEDKHFWAAFLNLARHNAYITLTHIDRQ
LAYSKADITNDQDVLSFKALWKNFDNDLERKSRLRSLILKHFSF
LEGAAYGKKLFESKSSGNKSSKNKELTKKEKEELQANALSLDN
LKSILFDFLQKLKDFRNYYSHYRHSESSELPLFDGNMLQRLYNV
FDVSVQRVKRDHEHNDKVDPHRHFNHLVRKGKKDRYGHNDN
PSFKHHFVDGEGMVTEAGLLFFVSLFLEKRDAIWMQKKIRGFK
GGTETYQQMTNEVFCRSRISLPKLKLESLRTDDWMLLDMLNEL
VRCPKPLYDRLREDDRACFRVPVDILPDEDDTDGGGEDPFKNT
LVRHQDRFPYFALRYFDLKKVFTSLRFHIDLGTYHFAIYKKMIG
EQPEDRHLTRNLYGFGRIQDFAEEHRPEEWKRLVRDLDYFETG
DKPYISQTSPHYHIEKGKIGLRFMPEGQHLWPSPEVGTTRTGRS
KYAQDKRLTAEAFLSVHELMPMMFYYFLLREKYSEEVSAEKV
QGRIKRVIEDVYAIYDAFARDEINTLKELDACLADKGIRRGHLP
KQMIAILSQEHKDMEEKIRKKLQEMIADTDHRLDMLDRQTDRK
IRIGRKNAGLPKSGVIADWLVRDMMRFQPVAKDTSGKPLNNSK
ANSTEYRMLQRALALFGGEKKRLTPYFRQMNLTGGNNPHPFLH
ETRWESHTNILSFYRSYLRARKAFLERIGRSDRMENRPFLLLKEP
KTDRQTLVAGWKSEFHLPRGIFTEAVRDCLIEMGYDEVGSYRE
VGFMAKAVPLYFERACEDRVQPFYDSPFNVGNSLKPKKGRFLS
KEERAEEWERGKERFRDLEAWSHSAARRIEDAFAGIEYASPGN
KKKIEQLLRDLSLWEAFESKLKVRADKINLAKLKKEILEAQEHP
YHDFKSWQKFERELRLVKNQDIITWMMCRDLMEENKVEGLDT
GTLYLKDIRPNVQEQGSLNVLNRVKPMRLPVVVYRADSRGHV
HKEEAPLATVYIEERDTKLLKQGNFKSFVKDRRLNGLFSFVDTG
GLAMEQYPISKLRVEYELAKYQTARVCVFELTLRLEESLLTRYP
HLPDESFRKMLESWSDPLLAKWPELHGKVRLLIAVRNAFSHNQ
YPMYDEAVFSSIRKYDPSSPDAIEERMGLNIAHRLSEEVKQAKE
TVERIIQV (SEQ ID NO: 98) |
| *Porphyromonas gulae* | WP_039437199 | MTEQSERPYNGTYYTLEDKHFWAAFLNLARHNAYITLTHIDRQ
LAYSKADITNDEDILFFKGQWKNLDNDLERKSRLRSLILKHFSF
LEGAAYGKKFFESKSSGNKSSKNKELTKKEKEELQANALSLDN
LKSILFDFLQKLKDFRNYYSHYRHSGSSELPLFDGNMLQRLYNV
FDVSVQRVKRDHEHNDEVDPHYHFNHLVRKGKKDRYGHNDN
PSFKHHFVDGEGMVTEAGLLFFVSLFLEKRDAIWMQKKIRGFK
GGTEPYEQMTNEVFCRSRISLPKLKLESLRTDDWMLLDMLNEL
VRCPKPLYDRLREKDRACFRVPVDILPDEDDTDGGGEDPFKNT
LVRHQDRFPYFALRYFDLKKVFTSLRFHIDLGTYHFAIYKKMIG
EQPEDRHLTRNLYGFGRIQDFAEEHRPEEWKRLVRDLDYFETG
DKPYISQTTPHYHIEKGKIGLRFVPEGQHLWPSPEVGTTRTGRSK
YAQDKRLTAEAFLSVHELMPMMFYYFLLREKYSEEVSAEKVQ
GRIKRVIEDVYAIYDAFARDEINTLKELDACLADKGIRRGHLPK
QMIGILSQERKDMEEKVRKKLQEMIADTDHRLDMLDRQTDRKI
RIGRKNAGLPKSGVIADWLVRDMMRFQPVAKDTSGKPLNNSK
ANSTEYRMLQRALALFGGEKERLTPYFRQMNLTGGNNPHPFLH
ETRWESHTNILSFYRSYLRARKAFLERIGRSDRVENCPFLLLKEP
KTDRQTLVAGWKGEFHLPRGIFTEAVRDCLIEMGYDEVGSYRE
VGFMAKAVPLYFERACEDRVQPFYDSPFNVGNSLKPKKGRFLS
KEKRAEEWESGKERFRLAKLKKEILEAQEHPYHDFKSWQKFER
ELRLVKNQDIITWMMCRDLMEENKVEGLDTGTLYLKDIRPNVQ |

| | | |
|---|---|---|
| | | EQGSLNVLNRVKPMRLPVVVYRADSRGHVHKEEAPLATVYIEE
RDTKLLKQGNFKSFVKDRRLNGLFSFVDTGALAMEQYPISKLR
VEYELAKYQTARVCAFEQTLELEESLLTRYPHLPDESFREMLES
WSDPLLTKWPELHGKVRLLIAVRNAFSHNQYPMYDEAVFSSIW
KYDPSSPDAIEERMGLNIAHRLSEEVKQAKETIERIIQA
(SEQ ID NO: 99) |
| *Porphyromonas gulae* | WP_
039442171 | MTEQSERPYNGTYYTLEDKHFWAAFLNLARHNAYITLTHIDRQ
LAYSKADITNDQDVLSFKALWKNLDNDLERKSRLRSLILKHFSF
LEGAAYGKKLFESKSSGNKSSKNKELTKKEKEELQANALSLDN
LKSILFDFLQKLKDFRNYYSHYRHSGSSELPLFDGNMLQRLYNV
FDVSVQRVKRDHEHNDKVDPHYHFNHLVRKGKKDRYGHNDN
PSFKHHFVDSEGMVTEAGLLFFVSLFLEKRDAIWMQKKIRGFK
GGTGPYEQMTNEVFCRSRISLPKLKLESLRTDDWMLLDMLNEL
VRCPKPLYDRLREKDRACFRVPVDILPDEDDTDGGGEDPFKNT
LVRHQDRFPYFALRYFDLKKVFTSLRFHIDLGTYHFAIYKKMIG
EQPEDRHLTRNLYGFGRIQDFAEEHRPEEWKRLVRDLDYLETG
DKPYISQTTPHYHIEKGKIGLRFVPEGQHLWPSPEVGTTRTGRSK
CAQDKRLTAEAFLSVHELMPMMFYYFLLREKYSEEVSAEKVQ
GRIKRVIEDVYAIYDAFARDEINTLKELDTCLADKGIRRGHLPK
QMITILSQERKDMKEKIRKKLQEMIADTDHRLDMLDRQTDRKI
RIGRKNAGLPKSGVIADWLVRDMMRFQPVAKDASGKPLNNSK
ANSTEYRMLQRALALFGGEKERLTPYFRQMNLTGGNNPHPFLH
ETRWESHTNILSFYRSYLRARKAFLERIGRSDRVENCPFLLLKEP
KTDRQTLVAGWKDEFHLPRGIFTEAVRDCLIEMGYDEVGSYRE
VGFMAKAVPLYFERACEDRVQPFYDSPFNVGNSLKPKKGRFLS
KEDRAEEWERGMERFRDLEAWSHSAARRIKDAFAGIEYASPGN
KKKIEQLLRDLSLWEAFESKLKVRADKINLAKLKKEILEAQEHP
YHDFKSWQKFERELRLVKNQDIITWMMCRDLMEENKVEGLDT
GTLYLKDIRPNVQEQGSLNVLNRVKPMRLPVVVYRADSRGHV
HKEAPLATVYIEERNTKLLKQGNFKSFVKDRRLNGLFSFVDTG
GLAMEQYPISKLRVEYELAKYQTARVCVFELTRLEESLLSRYP
HLPDESFREMLESWSDPLLAKWPELHGKVRLLIAVRNAFSHNQ
YPMYDEAVFSSIRKYDPSSPDAIEERMGLNIAHRLSEEVKQAKE
TVERIIQA (SEQ ID NO: 100) |
| *Porphyromonas gulae* | WP_
039445055 | MNTVPATENKGQSRTVEDDPQYFGLYLNLARENLIEVESHVRI
KFGKKKLNEESLKQSLLCDHLLSIDRWTKVYGHSRRYLPFLHCF
DPDSGIEKDHDSKTGVDPDSAQRLIRELYSLLDFLRNDFSHNRL
DGTTFEHLKVSPDISSFITGAYTFACERAQSRFADFFKPDDFLLA
KNRKEQLISVADGKECLTVSGFAFFICLFLDREQASGMLSRIRGF
KRTDENWARAVHETFCDLCIRHPHDRLESSNTKEALLLDMLNE
LNRCPRILYDMLPEEERAQFLPALDENSMNNLSENSLNEESRLL
WDGSSDWAEALTKRIRHQDRFPYLMLRFIEEMDLLKGIRFRVD
LGEIELDSYSKKVGRNGEYDRTITDHALAFGKLSDFQNEEEVSR
MISGEASYPVRFSLFAPRYAIYDNKIGYCHTSDPVYPKSKTGEK
RALSNPQSMGFISVHDLRKLLLMELLCEGSFSRMQSDFLRKANR
ILDETAEGKLQFSALFPEMRHRFIPPQNPKSKDRREKAETTLEKY
KQEIKGRKDKLNSQLLSAFDMNQRQLPSRLLDEWMNIRPASHS
VKLRTYVKQLNEDCRLRLRKFRKDGDGKARAIPLVGEMATFLS
QDIVRMIISEETKKLITSAYYNEMQRSLAQYAGEENRRQFRAIV
AELHLLDPSSGHPFLSATMETAHRYTEDFYKCYLEKKREWLAK
TFYRPEQDENTKRRISVFFVPDGEARKLLPLLIRRRMKEQNDLQ
DWIRNKQAHPIDLPSHLFDSKIIVIELLKVDGKKKWNEAFKDW
WSTKYPDGMQPFYGLRRELNIHGKSVSYIPSDGKKFADCYTHL
MEKTVRDKKRELRTAGKPVPPDLAAYIKRSFHRAVNEREFMLR
LVQEDDRLMLMAINKMMTDREEDILPGLKNIDSILDEENQFSLA
VHAKVLEKEGEGGDNSLSLVPATIEIKSKRKDWSKYIRYRYDR
RVPGLMSHFPEHKATLDEVKTLLGEYDRCRIKIFDWAFALEGAI
MSDRDLKPYLHESSSREGKSGEHSTLVKMLVEKKGCLTPDESQ
YLILIRNKAAHNQFPCAAEMPLIYRDVSAKVGSIEGSSAKDLPE
GSSLVDSLWKKYEMIIRKILPILDHENRFFGKLLNNMSQPINDL
(SEQ ID NO: 101) |
| *Capnocytophaga cynodegmi* | WP_
041989581 | MENKTSLGNNIYYNPFKPQDKSYFAGYLNAAMENIDSVFRELG
KRLKGKEYTSENFFDAIFKENISLVEYERYVKLLSDYFPMARLL
DKKEVPIKERKENFKKNFRGIIKAVRDLRNFYTHKEHGEVEITD
EIFGVLDEMLKSTVLTVKKKKIKTDKTKEILKKSIEKQLDILCQK
KLEYLKDTARKIEEKRRNQRERGEKKLVPRFEYSDRRDDLIAAI
YNDAFDVYIDKKKDSLKESSKTKYNTESYPQQEEGDLKIPISKN
GVVFLLSLFLSKQEVHAFKSKIAGFKATVIDEATVSHRKNSICF
MATHEIFSHLAYKKLKRKVRTAEINYSEAENAEQLSIYAKETLM
MQMLDELSKVPDVVYQNLSEDVQKTFIEDWNEYLKENNGDVG
TMEEEQVIHPVIRKRYEDKFNYFAIRFLDEFAQFPTLRFQVHLG
NYLHDSRPKEHLISDRRIKEKITVFGRLSELEHKKALFIKNTETN
EDRKHYWEVFPNPNYDFPKENISVNDKDPIAGSILDREKQPTA
GKIGIKVNLLNQKYISEVDKAVKAHQLKQRNNKPSIQNIIEEIVPI
NGSNPKEIIVFGGQPTAYLSMNDIHSILYEFFDKWEKKKEKLEK
KGEKELRKEIGKELEEKIVGKIQTQIQQIIDKDINAKILKPYQDDD |

|  |  | STAIDKEKLIKDLKQEQKILQKLKNEQTAREKEYQECIAYQEES
RKIKRSDKSRQKYLRNQLKRKYPEVPTRKEILYYQEKGKVAVW
LANDIKRFMPTDFKNEWKGEQHSLLQKSLAYYEQCKEELKNLL
PQQKVFKHLPFELGGHFQQKYLYQFYTRYLDKRLEHISGLVQQ
AENFKNENKVFKKVENECFKFLKKQNYTHKGLDAQAQSVLGY
PIFLERGFMDEKPTIIKGKTFKGNESLFTDWFRYYKEYQNFQTF
YDTENYPLVELEKKQADRKRETKIYQQKKNDVFTLLMAKHIFK
SVFKQDSIDRFSLEDLYQSREERLENQEKAKQTGERNTNYIWNK
TVDLNLCDGKVTVENVKLKNVGNFIKYEYDQRVQTFLKYEENI
KWQAFLIKESKEEENYPYIVEREIEQYEKVRREELLKEVHLIEEY
ILEKVKDKEILKKGDNQNFKYYILNGLLKQLKNEDVESYKVFN
LNTKPEDVNINQLKQEATDLEQKAFVLTYIRNKFAHNQLPKKEF
WDYCQEKYGKIEKEKTYAEYFAEVFKREKEALMK (SEQ ID NO: 102) |
| Prevotella sp. P5-119 | WP_042518169 | MNIPALVENQKKYFGTYSVMAMLNAQTVLDHIQKVADIEGEQ
NENNENLWFHPVMSHLYNAKNGYDKQPEKTMFIIERLQSYFPF
LKIMAENQREYSNGKYKQNRVEVNSNDIFEVLKRAFGVLKMY
RDLTNHYKTYEEKLIDGCEFLTSTEQPLSGMISKYYTVALRNTK
ERYGYKTEDLAFIQDNIKKITKDAYGKRKSQVNTGFFLSLQDYN
GDTQKKLHLSGVGIALLICLFLDKQYINIFLSRLPIFSSYNAQSEE
RRIIIRSFGINSIKLPKDRIHSEKSNKSVAMDMLNEVKRCPDELFT
TLSAEKQSRFRIISDDHNEVLMKRSTDRFVPLLLQYIDYGKLFD
HIRFHVNMGKLRYLLKADKTCIDGQTRVRVIEQPLNGFGRLEE
AETMRKQENGTFGNSGIRIRDFENVKRDDANPANYPYIVDTYT
HYILENNKVEMFISDKGSSAPLLPLIEDDRYVVKTIPSCRMSTLEI
PAMAFHMFLFGSKKTEKLIVDVHNRYKRLFQAMQKEEVTAENI
ASFGIAESDLPQKILDLISGNAHGKDVDAFIRLTVDDMLTDTER
RIKRFKDDRKSIRSADNKMGKRGFKQISTGKLADFLAKDIVLFQ
PSVNDGENKITGLNYRIMQSAIAVYDSGDDYEAKQQFKLMFEK
ARLIGKGTTEPHPPLYKVFARSIPANAVDFYERYLIERKFYLTGL
CNEIKRGNRVDVPFIRRDQNKWKTPAMKTLGRIYSEDLPVELPR
QMFDNEIKSHLKSLPQMEGIDFNNANVTYLIAEYMKRVLNDDF
QTFYQWKRNYHYMDMLKGEYDRKGSLQHCFTSVEEREGLWK
ERASRTERYRKLASNKIRSNRQMRNASSEEIETILDKRLSNCRNE
YQKSEKVIRRYRVQDALLFLLAKKTLTELADFDGERFKLKEIMP
DAEKGILSEIMPMSFTFEKGGKKYTITSEGMKLKNYGDPFVLAS
DKRIGNLLELVGSDIVSKEDIMEEFNKYDQCRPEISSIVFNLEKW
AFDTYPELSARVDREEKVDFKSILKILLNNKNINKEQSDILRKIR
NAFDHNNYPDKGIVEIKALPEIAMSIKKAFGEYAIMK
(SEQ ID NO: 103) |
| Prevotella sp.P4-76 | WP_044072147 | MNIPALVENQKKYFGTYSVMAMLNAQTVLDHIQKVADIEGEQ
NENNENLWFHPVMSHLYNAKNGYDKQPEKTMFIIERLQSYFPF
LKIMAENQREYSNGKYKQNRVEVNSNDIFEVLKRAFGVLKMY
RDQASHYKTYDEKLIDGCEFLTSTEQPLSGMINNYYTVALRNM
NERYGYKTEDLAFIQDKRFKFVKDAYGKKKSQVNTGFFLSLQD
YNGDTQKKLHLSGVGIALLICLFLDKQYINIFLSRLPIFSSYNAQS
EERRIIIRSFGINSIKQPKDRIHSEKSNKSVAMDMLNEIKRCPNEL
FETLSAEKQSRFRIISNDHNEVLMKRSSDRFVPLLLQYIDYGKLF
DHIRFHVNMGKLRYLLKADKTCIDGQTRVRVIEQPLNGFGRLE
EVETMRKQENGTFGNSGIRIRDFENMKRDDANPANYPYIVDTY
THYILENNKVEMFISDEETPAPLLPVIEDDRYVVKTIPSCRMSTL
EIPAMAFHMFLFGSKKTEKLIVDVHNRYKRLFKAMQKEEVTAE
NIASFGIAESDLPQKIIDLISGNAHGKDVDAFIRLTVDDMLADTE
RRIKRFKDDRKSIRSADNKMGKRGFKQISTGKLADFLAKDIVLF
QPSVNDGENKITGLNYRIMQSAIAVYNSGDDYEAKQQFKLMFE
KARLIGKGTTEPHPPLYKVFVRSIPANAVDFYERYLIERKFYLIG
LSNEIKKGNRVDVPFIRRDQNKWKTPAMKTLGRIYDEDLPVELP
RQMFDNEIKSHLKSLPQMEGIDFNNANVTYLIAEYMKRVLNDD
FQTFYQWKRNYRYMDMLRGEYDRKGSLQSCFTSVEEREGLWK
ERASRTERYRKLASNKIRSNRQMRNASSEEIETILDKRLSNSRNE
YQKSEKVIRRYRVQDALLFLLAKKTLTELADFDGERFKLKEIMP
DAEKGILSEIMPMSFTFEKGGKKYTITSEGMKLKNYGDPFVLAS
DKRIGNLLELVGSDTVSKEDIMEEFKKYDQCRPEISSIVFNLEKW
AFDTYPELSARVDREEKVDFKSILKILLNNKNINKEQSDILRKIR
NAFDHNNYPDKGVVEIRALPEIAMSIKKAFGEYAIMK
(SEQ ID NO: 104) |
| Prevotella sp. P5-60 | WP_044074780 | MNIPALVENQKKYFGTYSVMAMLNAQTVLDHIQKVADIEGEQ
NENNENLWFHPVMSHLYNAKNGYDKQPEKTMFIIERLQSYFPF
LKIMAENQREYSNGKYKQNRVEVNSNDIFEVLKRAFGVLKMY
RDLTNHYKTYEEKLIDGCEFLTSTEQPFSGMISKYYTVALRNTK
ERYGYKAEDLAFIQDNRYKFTKDAYGKRKSQVNTGSFLSLQDY
NGDTTKKLHLSGVGIALLICLFLDKQYINLFLSRLPIFSSYNAQSE
ERRIIIRSFGINSIKQPKDRIHSEKSNKSVAMDMLNEVKRCPDELF
TTLSAEKQSRFRIISDDHNEVLMKRSSDRFVPLLLQYIDYGKLFD
HIRFHVNMGKLRYLLKADKTCIDGQTRVRVIEQPLNGFGRLEE
VETMRKQENGTFGNSGIRIRDFENMKRDDANPANYPYIVETYT
HYILENNKVEMFISDEENPTPLLPVIEDDRYVVKTIPSCRMSTLEI |

|   |   |   |
|---|---|---|
| | | PAMAFHMPLFGSEKTEKLIIDVHDRYKRLFQAMQKEEVTAENI
ASFGIAESDLPQKIMDLISGNAHGKDVDAFIRLTVDDMLTDTER
RIKRFKDDRKSIRSADNKMGKRGFKQISTGKLADFLAKDIVLFQ
PSVNDGENKITGLNYRIMQSAIAVYDSGDDYEAKQQFKLMFEK
ARLIGKGTTEPHPPLYKVFVRSIPANAVDFYERYLIERKFYLIGL
SNEIKKGNRVDVPFIRRDQNKWKTPAMKTLGRIYSEDLPVELPR
QMFDNEIKSHLKSLPQMEGIDFNNANVTYLIAEYMKRVLNDDF
QTFYQWKRNYRYMDMLRGEYDRKGSLQHCFTSIEEREGLWKE
RASRTERYRKLASNKIRSNRQMRNASSEEIETILDKRLSNCRNE
YQKSEKIIRRYRVQDALLFLLAKKTLTELADFDGERFKLKEIMP
DAEKGILSEIMPMSFTFEKGGKIYTITSGGMKLKNYGDPFVLAS
DKRIGNLLELVGSNTVSKEDIMEEFKKYDQCRPEISSIVFNLEKW
AFDTYPELPARVDRKEKVDFWSILDVLSNNKDINNEQSYILRKI
RNAFDHNNYPDKGIVEIKALPEIAMSIKKAFGEYAIMK
(SEQ ID NO: 105) |
| *Phaeo-
dactylibacter
xiamenensis* | WP_
044218239 | MTNTPKRRTLHRHPSYFGAFLNIARHNAFMIMEHLSTKYDMED
KNTLDEAQLPNAKLFGCLKKRYGKPDVTEGVSRDLRRYFPFLN
YPLFLHLEKQQNAEQAATYDINPEDIEFTLKGFFRLLNQMRNNY
SHYISNTDYGKFDKLPVQDIYEAAIFRLLDRGKHTKRFDVFESK
HTRHLESNNSEYRPRSLANSPDHENTVAFVTCLFLERKYAFPFL
SRLDCFRSTNDAAEGDPLIRKASHECYTMFCCRLPQPKLESSDIL
LDMVNELGRCPSALYNLLSEEDQARFHIKREEITGFEEDPDEELE
QEIVLKRHSDRFPYFALRYFDDTEAFQTLRFDVYLGRWRTKPV
YKKRIYGQERDRVLTQSIRTFTRLSRLLPIYENVKHDAVRQNEE
DGKLVNPDVTSQPHKSWIQIESDDRAFLSDRIEHFSPHYNFGDQ
VIGLKFINPDRYAAIQNVFPKLPGEEKKDKDAKLVNETADAIIST
HEIRSLFLYHYLSKKPISAGDERRFIQVDTETFIKQYIDTIKLFFED
IKSGELQPIADPPNYQKNEPLPYVRGDKEKTQEERAQYRERQKE
IKERRKELNTLLQNRYGLSIQYIPSRLREYLLGYKKVPYEKLAL
QKLRAQRKEVKKRIKDIEKMRTPRVGEQATWLAEDIVFLTPPK
MHTPERKTTKHPQKLNNDQFRIMQSSLAYFSVNKKAIKKFFQK
ETGIGLSNRETSHPFLYRIDVGRCRGILDFYTGYLKYKMDWLDD
AIKKVDNRKHGKKEAKKYEKYLPSSIQHKTPLELDYTRLPVYLP
RGLFKKAIVKALAAHADFQVEPEEDNVIFCLDQLLDGDTQDFY
NWQRYYRSALTEKETDNQLVLAHPYAEQILGTIKTLEGKQKNN
KLGNKAKQKIKDELIDLKRAKRRLLDREQYLRAVQAEDRALW
LMIQERQKQKAEHEEIAFDQLDLKNITKILTESIDARLRIPDTKV
DITDKLPLRRYGDLRRVAKDRRLVNLASYYHVAGLSEIPYDLV
KKELEEYDRRRVAFFEHVYQFEKEVYDRYAAELRNENPKGEST
YFSHWEYVAVAVKHSADTHFNELFKEKVMQLRNKFHHNEFPY
FDWLLPEVEKASAALYADRVFDVAEGYYQKMRKLMRQ
(SEQ ID NO: 106) |
| *Flavo-
bacterium
sp. 316* | WP_
045968377 | MDNNITVEKTELGLGITYNHDKVEDKHYFGGFFNLAQNNIDLV
AQEFKKRLLIQGKDSINIFANYFSDQCSITNLERGIKILAEYFPVV
SYIDLDEKNKSKSIREHLILLLETINNLRNYYTHYYHKKIIIDGSL
FPLLDTILLKVVLEIKKKKLKEDKTKQLLKKGLEKEMTILFNLM
KAEQKEKKIKGWNIDENIKGAVLNRAFSHLLYNDELSDYRKSK
YNTEDETLKDTLTESGILFLLSFFLNKKEQEQLKANIKGYKGKIA
SIPDEEITLKNNSLRNMATHWTYSHLTYGKLKHRIKTDHEKETL
LVNMVDYLSKVPHEIYQNLSEQNKSLFLEDINEYMRDNEENHD
SSEASRVIHPVIRKRYENKFAYFAIRFLDEFAEFPTLRFMVNVGN
YIHDNRKKDIGGTSLITNRTIKQQINVFGNLTEIHKKKNDYFEKE
ENKEKTLEWELFPNPSYHFQKENIPIFIDLEKSKETNDLAKEYAK
EKKKIFGSSRKKQQNTAKKNRETIINLVFDKYKTSDRKTVTFEQ
PTALLSFNELNSFLYAFLVENKTGKELEKIIIEKIANQYQILKNCS
STVDKTNDNIPKSIKKIVNTTTDSFYFEGKKIDIEKLEKDITIEIEK
TNEKLETIKENEESAQNYKRNERNTQKRKLYRKYVFFTNEIGIE
ATWITNDILRFLDNKENWKGYQHSELQKFISQYDNYKKEALGL
LESEWNLESDAFFGQNLKRMFQSNSTFETFYKKYLDNRKNTLE
TYLSAIENLKTMTDVRPKVLKKKWTELFRFFDKKIYLLSTIETKI
NELITKPINLSRGIFEEKPTFINGKNPNKENNQHLFANWFIYAKK
QTILQDFYNLPLEQPKAITNLKKHKYKLERSINNLKIEDIYIKQM
VDFLYQKLFEQSFIGSLQDLYTSKEKREIEKGKAKNEQTPDESFI
WKKQVEINTHNGRIIAKTKIKDIGKFKNLLTDNKIAHLISYDDRI
WDFSLNNDGDITKKLYSINTELESYETIRREKLLKQIQQFEQFLL
EQETEYSAERKHPEKFEKDCNPNFKKYIIEGVLNKIIPNHEIEEIEI
LKSKEDVFKINFSDILILNNDNIKKGYLLEVIIRNKFAHNQLIDKN
LFNFSLQLYSKNENENFSEYLNKVCQNIIQEFKEKLK
(SEQ ID NO: 107) |
| *Porphyromonas
gulae* | WP_
046201018 | MTEQSERPYNGTYYTLEDKHFWAAFLNLARHNAYITLTHIDRQ
LAYSKADITNDQDVLSFKALWKNFDNDLERKSRLRSLILKHFSF
LEGAAYGKKLFESKSSGNKSSKNKELTKKEKEELQANALSLDN
LKSILFDFLQKLKDFRNYYSHYRHSESSELPLFDGNMLQRLYNV
FDVSVQRVKRDHEHNDKVDPHRHFNHLVRKGKKDRYGHNDN
PSFKHHFVDSEGMVTEAGLLFFVSLFLEKRDAIWMQKKIRGFK
GGTETYQQMTNEVFCRSRISLPKLKLESLRTDDWMLLDMLNEL |

| | | VRCPKPLYDRLREKDRARFRVPVDILPDEDDTDGGGEDPFKNT
LVRHQDRFPYFALRYFDLKKVFTSLRFHIDLGTYHFAIYKKMIG
EQPEDRHLTRNLYGFGRIQDFAEEHRPEEWKRLVRDLDYFETG
DKPYISQTTPHYHIEKGKIGLRFMPEGQHLWPSPEVGTTRTGRS
KYAQDKRLTAEAFLSVHELMPMMFYYFLLREKYSEEVSAEKV
QGRIKRVIEDVYAIYDAFARDEINTLKELDACLADKGIRRGHLP
KQMIAILSQEHKDMEEKIRKKLQEMIADTDHRLDMLDRQTDRK
IRIGRKNAGLPKSGVIADWLVRDMMRFQPVAKDTSGKPLNNSK
ANSTEYRMLQRALALFGGEKKRLTPYFRQMNLTGGNNPHPFLH
ETRWESHTNILSFYRSYLRARKAFLERIGRSDRMENRPFLLLKEP
KTDRQTLVAGWKSEFHLPRGIFTEAVRDCLIEMGYDEVGSYRE
VGFMAKAVPLYFERACEDRVQPFYDSPFNVGNSLKPKKGRFLS
KEERAEEWERGKERFRDLEAWSHSAARRIEDAFAGIEYASPGN
KKKIEQLLRDLSLWEAFESKLKVRADKINLAKLKKEILEAQEHP
YHDPFKSWQKFERELRLVKNQDIITWMMCRDLMEENKVEGLDT
GTLYLKDIRPNVQEQGSLNVLNRVKPMRLPVVVYRADSRGHV
HKEEAPLATVYIEERDTKLLKQGNFKSFVKDRRLNGLFSFVDTG
GLAMEQYPISKLRVEYELAKYQTARVCVFELTLRLEESLLTRYP
HLPDESFRKMLESWSDPLLAKWPELHGKVRLLIAVRNAFSHNQ
YPMYDEAVFSSIRKYDPSSPDAIEERMGLNIAHRLSEEVKQAKE
TVERIIQV (SEQ ID NO: 108) |
| WP_047431796 | Chryseo-
bacterium
sp.
YR477 | METQTIGHGIAYDHSKIQDKHFFGGFLNLAENNIKAVLKAFSEK
FNVGNVDVKQFADVSLKDNLPDNDFQKRVSFLKMYFPVVDFIN
IPNNRAKFRSDLTTLFKSVDQLRNFYTHYYHKPLDFDASLFILLD
DIFARTAKEVRDQKMKDDKTRQLLSKSLSEELQKGYELQLERL
KELNRLGKKVNIHDQLGIKNGVLNNAFNHLIYKDGESFKTKLT
YSSALTSFESAENGIEISQSGLLFLLSMFLKRKEIEDLKNRNKGF
KAKVVIDEDGKVNGLKFMATHWVFSYLCFKGLKSKLSTEFHEE
TLLIQIIDELSKVPDELYCAFDKETRDKFIEDINEYVKEGHQDFSL
EDAKVIHPVIRKRYENKFNYFAIRFLDEFVKFPSLRFQVHVGNY
VHDRRIKNIDGTTFETERVVKDRIKVFGRLSETSSYKAQYLSSVS
DKHDETGWEIFPNPSYVFINNNIPIHISVDTSFKKEIADFKKLRRA
QVPDELKIRGAEKKRKFEITQMIGSKSVLNQEEPIALLSLNEIPAL
LYEILINGKEPAEIERIIKDKLNERQDVIKNYNPENWLPASQISRR
LRSNKGERIINTDKLLQLVTKELLVTEQLKIISDNREALKQKKE
GKYIRKFIFTNSELGREAIWLADDIKRFMPADVRKEWKGYQHS
QLQQSLAFYNSRPKEALAILESSWNLKDEKIIWNEWILKSFTQN
KFFDAFYNEYLKGRKKYFAFLSEHIVQYTSNAKNLQKFIKQQM
PKDLFEKRHYIIEDLQTEKNKILSKPFIPPRGIFDKKPTFIKGVKV
EDSPESFANWYQYGYQKDHQFQKFYDWKRDYSDVFLEHLGKP
FINNGDRRTLGMEELKERIIIKQDLKIKKKIKIQDLFLRLIAENLFQ
KVFKYSAKLPLSDFYLTQEERMEKENMAALQNVREEGDKSPNI
IKDNFIWSKMIPYKKGQIIENAVKLKDIGKLNVLSLDDKVQTLL
SYDDAKPWSKIALENEFSIGENSYEVIRREKLFKEIQQFESEILFR
SGWDGINHPAQLEDNRNPKFKMYIVNGILRKSAGLYSQGEDIW
FEYNADFNNLDADVLETKSELVQLAFLVTAIRNKFAHNQLPAK
EFYFYIRAKYGFADEPSVALVYLNFTKYAINEFKKVMI
(SEQ ID NO: 109) |
| Riemerella
anatipestifer | WP_049354263 | MFFSFHNAQRVIFKHLYKAFDASLRMVKEDYKAHFTVNLTRDF
AHLNRKGKNKQDNPDFNRYRFEKDGFFTESGLLFFTNLFLDKR
DAYWMLKKVSGFKASHKQREKMTTEVFCRSRILLPKLRLESRY
DHNQMLLDMLSELSRCPKLLYEKLSEENKKHFQVEADGFLDEI
EEEQNPFKDTLIRHQDRFPYFALRYLDLNESFKSIRFQVDLGTYH
YCIYDKKIGDEQEKRHLTRTLLSFGRLQDFTEINRPQEWKALTK
DLDYKETSNQPFISKTTPHYHITDNKIGRLGTSKELYPSLEIKDG
ANRIAKYPYNSGFVAHAFISVHELLPLMFYQHLTGKSEDLLKET
VRHIQRIYKDFEEERINTIEDLEKANQGRLPLGAFPKQMLGLLQ
NKQPDLSEKAKIKIEKLIAETKLLSHRLNTKLKSSPKLGKRREKL
IKTGVLADWLVKDFMRFQPVAYDAQNQPIKSSKANSTEFWFIR
RALALYGGEKNRLEGYFKQTNLIGNTNPHPFLNKFNWKACRNL
VDFYQQYLEQREKFLEAIKNQPWEPYQYCLLLKIPKENRKNLV
KGWEQGGISLPRGLFTEAIRETLSEDLMLSKPIRKEIKKHGRVGF
ISRAITLYFKEKYQDKHQSFYNLSYKLEAKAPLLKREEHYEYW
QQNKPQSPTESQRLELHTSDRWKDYLLYKRWQHLEKKLRLYR
NQDVMLWLMTLELTKNHFKELNLNYHQLKLENLAVNVQEAD
AKLNPLNQTLPMVLPVKVYPATAFGEVQYHKTPIRTVYIREEHT
KALKMGNFKALVKDRRLNGLFSFIKEENDTQKHPISQLRLRREL
EIYQSLRVDAFKETLSLEEKLLNKHTSLSSLENEFRALLEEWKK
EYAASSMVTDEHIAFIASVRNAFCHNQYPFYKEALHAPIPLFTV
AQPTTEEKDGLGIAEALLKVLREYCEIVKSQI (SEQ ID NO: 110) |
| Porphyromonas
gingivalis | WP_052912312 | MTEQNEKPYNGTYYTLEDKHFWAAFFNLARHNAYITLAHIDRQ
LAYSKADITNDEDILFFKGQWKNLDNDLERKARLRSLILKHFSF
LEGAAYGKKLFESQSSGNKSSKKKELTKKEKEELQANALSLDN
LKSILFDFLQKLKDFRNYYSHYRHPESSELPLFDGNMLQRLYNV
FDVSVQRVKRDHEHNDKVPDHRHFNHLVRKGKKDKYGNNDN
PFFKHHFVDREEKVTEAGLLFFVSLFLEKRDAIWMQKKIRGFKG |

-continued

| | | |
|---|---|---|
| | | GTEAYQQMTNEVFCRSRISLPKLKLESLRTDDWMLLDMLNELV<br>RCPKLLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQLLWPSPEVGATRTGRSKY<br>AQDKRFTAEAFLSVHELMPMMFYYFLLREKYSEEASAEKVQG<br>RIKRVIEDVYAVYDAFARDEINTRDELDACLADKGIRRGHLPRQ<br>MIAILSQEHKDMEEKVRKKLQEMIADTDHRLDMLDRQTDRKIR<br>IGRKNAGLPKSGVIADWLVRDMIVIRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDREENHRFLLLKEPK<br>TDRQTLVAGWKSEFHLPRGIFTEAVRDCHEMGYDEVGSYKEV<br>GFMAKAVPLYFERACKDRVQPFYDYPFNVGNSLKPKKGRFLSK<br>EKRAEEWESGKERFRDLEAWSHSAARRIEDAFVGIEYASWENK<br>KKIEQLLQDLSLWETFESKLKVKADKINIAKLKKEILEAKEHPY<br>HDFKSWQKFERELRLVKNQDIITWMMCRDLMEENKVEGLDTG<br>TLYLKDIRTDVQEQGSLNVLNHVKPMRLPVVVYRADSRGHVH<br>KEEAPLATVYIEERDTKLLKQGNFKSFVKDRRLNGLFSFVDTGA<br>LAMEQYPISKLRVEYELAKYQTARVCAFEQTLELEESLLTRYPH<br>LPDESFREMLESWSDPLLDKWPDLQREVRLLIAVRNAFSHNQY<br>PMYDETIFSSIRKYDPSSLDAIEERMGLNIAHRLSEEVKLAKEMV<br>ERIIQA (SEQ ID NO: 111) |
| Porphyromonas<br>gingivalis | WP_<br>058019250 | MTEQNEKPYNGTYYTLKDKHFWAAFFNLARHNAYITLTHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPMFDGNMLQRLYN<br>VFDVSVQRVKRDHEHNDKVDPHRHFNHLVRKGKKDRCGNND<br>NPPFKHHFVDREGKVTEAGLLFFVSLFLEKRDAIWMQKKIRGF<br>KGGTETYQQMTNEVFCRSRISLPKLKLESLRTDDWMLLDMLNE<br>LVRCPKSLYDRLREEDRACFRVPVDILSDEDDTDGAEEDPFKNT<br>LVRHQDRFPYFALRYFDLKKVFTSLRFHIDLGTYHFAIYKKNIG<br>EQPEDRHLTRNLYGFGRIQDFAEEHRPEEWKRLVRDLDCFETG<br>DKPYITQTTPHYHIEKGKIGLRFVPEGQHLWPSPEVGATRTGRS<br>KYAQDKRFTAEAFLSVHELMPMMFYYFLLREKYSEEVSAERV<br>QGRIKRVIEDVYAVYDAFARDEINTRDELDACLADKGIRRGHLP<br>RQMIAILSQKHKDMEEKVRKKLQEMIADTDHRLDMLDRQTDR<br>KIRIGRKNAGLPKSGVIADWLVRDMMRFQPVAKDTSGKPLNNS<br>KANSTEYRMLQRALALFGGEKERLTPYFRQMNLTGGNNPHPFL<br>HETRWESHTNILSFYRSYLKARKAFLQSIGRSDRVENHRFLLLK<br>EPKTDRQTLVAGWKGEFHLPRGIFTEAVRDCLIEMGLDEVGSY<br>KEVGFMAKAVPLYFERACKDRVQPFYDYPFNVGNSLKPKKGR<br>FLSKEKRAEEWESGKERFRDLEAWSHSAARRIEDAFAGIENASR<br>ENKKKIEQLLQDLSLWETFESKLKVKADKINIAKLKKEILEAKE<br>HPYLDFKSWQKFERELRLVKNQDIITWMMCRDLMEENKVEGL<br>DTGTLYLKDIRTDVQEQGSLNVLNHVKPMRLPVVVYRADSRG<br>HVHKEQAPLATVYIEERDTKLLKQGNFKSFVKDRRLNGLFSFV<br>DTGALAMEQYPISKLRVEYELAKYQTARVCAFEQTLELEESLLT<br>RYPHLPDENFRKMLESWSDPLLDKWPDLHRKVRLLIAVRNAFS<br>HNQYPMYDEAVFSSIRKYDPSSPDAIEERMGLNIAHRLSEEVKQ<br>AKEMAERIIQA (SEQ ID NO: 112) |
| Flavo-<br>bacterium<br>columnare | WP_<br>060381855 | MSSKNESYNKQKTFNHYKQEDKYFFGGFLNNADDNLRQVGKE<br>FKTRINFNHNNNELASVFKDYFNKEKSVAKREHALNLLSNYFP<br>VLERIQKHTNHNFEQTREIFELLLDTIKKLRDYYTHHYHKPITIN<br>PKVYDFLDDTLLDVLITIKKKKVKNDTSRELLKEKFRPELTQLK<br>NQKREELIKKGKKLLEENLENAVFNHCLRPFLEENKTDDKQNK<br>TVSLRKYRKSKPNEETSITLTQSGLVFLISFFLHRKEFQVFTSGLE<br>GFKAKVNTIKEEEISLNKNNIVYMITHWSYSYYNFKGLKHRIKT<br>DQGVSTLEQNNTTHSLTNTNTKEALLTQIVDYLSKVPNEIYETL<br>SEKQQKEFEEDINEYMRENPENEDSTFSSIVSHKVIRKRYENKFN<br>YFAMRFLDEYAELPTLRFMVNFGDYIKDRQKKILESIQFDSERII<br>KKEIHLFEKLGLVTEYKKNVYLKETSNIDLSRFPLFPSPSYVMA<br>NNNIPFYIDSRSNNLDEYLNQKKKAQSQNRKRNLTFEKYNKEQ<br>SKDAIIAMLQKEIGVKDLQQRSTIGLLSCNELPSMLYEVIVKDIK<br>GAELENKIAQKIREQYQSIRDFTLDSPQKDNIPTTLTKTISTDTSV<br>TFENQPIDIPRLKNALQKELTLTQEKLLNVKQHEIEVDNYNRNK<br>NTYKFKNQPKDKVDDNKLQRKYVFYRNEIGQEANWLASDLIH<br>FMKNKSLWKGYMHNELQSFLAFFEDKKNDCIALLETVFNLKED<br>CILTKDLKNLFLKHGNFIDFYKEYLKLKEDFLNTESTFLENGFIG<br>LPPKILKKELSKRLNYIFIVFQKRQFIIKELEEKKNNLYADAINLS<br>RGIFDEKPTMIPPKKPNPDEFASWFVASYQYNNYQSFYELTPDK<br>IENDKKKKYKNLRAINKVKIQDYYLKLMVDTLYQDLFNQPLDK<br>SLSDFYVSKTDREKIKADAKAYQKRNDSFLWNKVIHLSLQNNR<br>ITANPKLKDIGKYKRALQDEKIATLLTYDDRTWTYALQKPEKE<br>NENDYKELHYTALNMELQEYEKVRSKKLLKQVQELEKQILDKF |

-continued

| | | |
|---|---|---|
| | | YDFSNNATHPEDLEIEDKKGKRHPNFKLYITKALLKNESEIINLE<br>NIDIEILIKYYDYNTEKLKEKIKNMDEDEKAKIVNTKENYNKITN<br>VLIKKALVLIIIRNKMAHNQYPPKFIYDLATRFVPKKEEEYFACY<br>FNRVFETITTELWENKKKAKEIV (SEQ ID NO: 113) |
| Porphyromonas<br>gingivalis | WP_<br>061156470 | MTEQNERPYNGTYYTLEDKHFWAAFFNLARHNAYITLTHIDRQ<br>LAYSKADITNDEDILFFKGQWKNLDNDLERKARLRSLILKHFSF<br>LEGAAYGKKLFENKSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRCGNNDN<br>PFFKHHFVDREGKVTEAGLLFFVSLFLEKRDAIWMQKKIRGFK<br>GGTEAYQQMTNEVFCRSRISLPKLKLESLRTDDWMLLDMLNEL<br>VRCPKSLYDRLREEDRARFRVPVDILSDEDDTDGTEEDPFKNTL<br>VRHQDRFPYFALRYFDLKKVFTSLRFHIDLGTYHFAIYKKNIGE<br>QPEDRHLTRNLYGFGRIQDFAEEHRPEEWKRLVRDLDYFETGD<br>KPYITQTTPHYHIEKGKIGLRFVPEGQHLWPSPEVGATRTGRSK<br>YAQDKRLTAEAFLSVHELMPMMFYYFLLREKYSEEVSAEKVQ<br>GRIKRVIEDVYAVYDAFARGEIDTLDRLDACLADKGIRRGHLPR<br>QMIAILSQEHKDMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLH<br>ETRWESHTNILSFYRSYLKARKAFLQSIGRSDREENHRFLLLKEP<br>KTDRQTLVAGWKSEFHLPRGIFTEAVRDCLIEMGYDEVGSYKE<br>VGFMAKAVPLYFERACKDRVQPFYDYPFNVGNSLKPKKGRFLS<br>KEKRAEEWESGKERFRLAKLKKEILEAKEHPYLDFKSWQKFER<br>ELRLVKNQDIITWMMCRDLMEENKVEGLDTGTLYLKDIRTEVQ<br>EQGSLNVLNRVKPMRLPVVVYRADSRGHVHKEQAPLATVYIEE<br>RDTKLLKQGNFKSFVKDRRLNGLFSFVDTGGLAMEQYPISKLR<br>VEYELAKYQTARVCAFEQTLELEESLLTRCPHLPDKNFRKMLES<br>WSDPLLDKWPDLQREVWLLIAVRNAFSHNQYPMYDEAVFSSIR<br>KYDPSSPDAIEERMGLNIAHRLSEEVKQAKEMAERIIQA<br>(SEQ ID NO: 114) |
| Porphyromonas<br>gingivalis | WP_<br>061156637 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPPLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIFIGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL<br>(SEQ ID NO: 115) |
| Riemerella<br>anatipestifer | WP_<br>061710138 | MFFSFHNAQRVIFKHLYKAFDASLRMVKEDYKAHFTVNLTRDF<br>AHLNRKGKNKQDNPDFNRYRFEKDGFFTESGLLFTDNLFLDKR<br>DAYWMLKKVSGFKASHKQSEKMTTEVFCRSRILLPKLRLESRY<br>DHNQMLLDMLSELSRCPKLLYEKLSEKDKKCFQVEADGPLDEI<br>EEEQNPFKDTLIRHQDRFPYFALRYLDLNESFKSIRFQVDLGTYH<br>YCIYDKKIGYEQEKRHLTRTLLNFGRLQDFTEINRPQEWKALTK<br>DLDYNETSNQPFISKTTPHYHITDNKIGFRLRTSKELYPSLEVKD<br>GANRIAKYPYNSDFVAHAFISISVHELLPLMFYQHLTGKSEDLL<br>KETVRHIQRIYKDFEEERINTIEDLEKANQGRLPLGAFPKQMLGL<br>LQNKQPDLSEKAKIKIEKLIAETKLLSHRLNTKLKSSPKLGKRRE<br>KLIKTGVLADWLVKDFMRFQPVVYDAQNQPIKSSKANSTESRLI<br>RRALALYGGEKNRLEGYFKQTNLIGNTNPHPFLNKFNWKACRN<br>LVDFYQQYLEQREKFLEAIKHQPWEPYQYCLLLKVPKENRKNL<br>VKGWEQGGISLPRGLFTEAIRETLSKDLTLSKPIRKEIKKHGRVG<br>FISRAITLYFKEKYQDKHQSFYNLSYKLEAKAPLLKKEEHYEYW<br>QQNKPQSPTESQRLELHTSDRWKDYLLYKRWQHLEKKLRLYR<br>NQDIMLWLMTLELTKNHFKELNLNYHQLKLENLAVNVQEADA<br>KLNPLNQTLPMVLPVKVYPTTAFGEVQYHETPIRTVYIREEQTK |

| | | |
|---|---|---|
| | | ALKMGNFKALVKDRHLNGLFSFIKEENDTQKHPISQLRLRRELE<br>IYQSLRVDAFKETLSLEEKLLNKHASLSSLENEFRTLLEEWKKK<br>YAASSMVTDKHIAFIASVRNAFCHNQYPFYKETLHAPILLFTVA<br>QPTTEEKDGLGIAEALLRVLREYCEIVKSQI (SEQ ID NO: 116) |
| Flavobacterium<br>columnare | WP_<br>063744070 | MSSKNESYNKQKTFNHYKQEDKYFFGGFLNNADDNLRQVGKE<br>FKTRINFNHINNNELASVFKDYFNKEKSVAKREHALNLLSNYFP<br>VLERIQKHTNHNFEQTREIFELLLDTIKKLRDYYTHHYHKPITIN<br>PKIYDFLDDTLLDVLITIKKKKVKNDTSRELLKEKLRPELTQLKN<br>QKREELIKKGKKLLEENLENAVFNHCLRPFLEENKTDDKQNKT<br>VSLRKYRKSKPNEETSITLTQSGLVFLMSFFLHRKEFQVFTSGLE<br>GFKAKVNTIKEEKISLNKNNIVYMITHWSYSYYNFKGLKHRIKT<br>DQGVSTLEQNNTTHSLTNTNTKEALLTQIVDYLSKVPNEIYETL<br>SEKQQKEFEEDINEYMRENPENEDSTFSSIVSHKVIRKRYENKFN<br>YFAMRFLDEYAELPTLRFMVNFGDYIKDRQKKILESIQFDSERII<br>KKEIHLFEKLGLVTEYKKNVYLKETSNIDLSRFPLFPSPSYVMA<br>NNNIPFYIDSRSNNLDEYLNQKKKAQSQNRKRNLTFEKYNKEQ<br>SKDAIIAMLQKEIGVKDLQQRSTIGLLSCNELPSMLYEVIVKDIK<br>GAELENKIAQKIREQYQSIRDFTLNSPQKDNIPTTLIKTISTDTSV<br>TFENQPIDIPRLKNAIQKELALTQEKLLNVKQHEIEVNNYNRNK<br>NTYKFKNQPKDKVDDNKLQRKYVFYRNEIGQEANWLASDLIH<br>FMKNKSLWKGYMHNELQSFLAFFEDKKNDCIALLETVFNLKED<br>CILTKDLKNLFLKHGNFIDFYKEYLKLKEDFLNTESTFLENGFIG<br>LPPKILKKELSKRLNYIFIVFQKRQFIIKELEEKKNNLYADAINLS<br>RGIFDEKPTMIPFKKPNPDEFASWFVASYQYNNYQSFYELTPDK<br>IENDKKKKYKNLRAINKVKIQDYYLKLMVDTLYQDLFNQPLDK<br>SLSDFYVSKTDREKIKADAKAYQKRNDSFLWNKVIHLSLQNNR<br>ITANPKLKDIGKYKRALQDEKIATLLTYDDRTWTYALQKPEKE<br>NENDYKELHYTALNMELQEYEKVRSKKLLKQVQELEKQILDKF<br>YDFSNNATHPEDLEIEDKKGKRHPNFKLYITKALLKNESEIINLE<br>NIDIEILIKYYDYNTEKLKEKIKNMDEDEKAKIVNTKENYNKITN<br>VLIKKALVLIIIRNKMAHNQYPPKFIYDLATRFVPKKEEEYFACY<br>FNRVFETITTELWENKKKAKEIV (SEQ ID NO: 117) |
| Riemerella<br>anatipestifer | WP_<br>064970887 | MEKPLPPNVYTLKHKFFWGAFLNIARHNAFITICHINEQLGLTTP<br>PNDDKIADVVCGTWNNILNNDHDLLKKSQLTELILKHFPFLAA<br>MCYHPPKKEGKKKGSQKEQQKEKENEAQSQAEALNPSELIKVL<br>KTLVKQLRTLRNYYSHHSHKKPDAEKDIFKHLYKAFDASLRMV<br>KEDYKAHFTVNLTQDFAHLNRKGKNKQDNPDFDRYRFEKDGF<br>FTESGLLFFTNLFLDKRDAYWMLKKVSGFKASHKQSEKMTTEV<br>FCRSRILLPKLRLESRYDHNQMLLDMLSELSRYPKLLYEKLSEE<br>DKKRFQVEADGFLDEIEEEQNPFKDTLIRHQDRFPYFALRYLDL<br>NESFKSIRFQVDLGTYHYCIYDKKIGDEQEKRHLTRTLLSFGRL<br>QDFTEINRPQEWKALTKDLDYKETSKQPFISKTTPHYHITDNKIG<br>FRLGTSKELYPSLEVKDGANRIAQYPYNSDFVAHAFISVHELLP<br>LMFYQHLTGKSEDLLKETVRHIQRIYKDFEEERINTIEDLEKANQ<br>GRLPLGAFPKQMLGLLQNKQPDLSEKAKIKIEKLIAETKLLSHR<br>LNTKLKSSPKLGKRREKLIKTGVLADWLVKDFMRFQPVAYDA<br>QNQPIESSKANSTEFQLIQRALALYGGEKNRLEGYFKQTNLIGN<br>TNPHPFLNKFNWKACRNLVDFYQQYLEQREKFLEAIKNQPWEP<br>YQYCLLLKIPKENRKNLVKGWEQGGISLPRGLFTEAIRETLSKD<br>LTLSKPIRKEIKKHGRVGFISRAITLYFREKYQDDHQSFYDLPYK<br>LEAKASPLPKKEHYEYWQQNKPQSPTELQRLELHTSDRWKDYL<br>LYKRWQHLEKKLRLYRNQDVMLWLMTLELTKNHFKELNLNY<br>HQLKLENLAVNVQEADAKLNPLNQTLPMVLPVKVYPATAFGE<br>VQYQETPIRTVYIREEQTKALKMGNFKALVKDRRLNGLFSFIKE<br>ENDTQKHPISQLRLRRELEIYQSLRVDAFKETLNLEEKLLKKHTS<br>LSSVENKFRILLEEWKKEYAASSMVTDEHIAFIASVRNAFCHNQ<br>YPFYEEALHAPIPLFTVAQQTTEEKDGLGIAEALLRVLREYCEIV<br>KSQI (SEQ ID NO: 118) |

A Table 1A or Table 1B Cas13b effector protein of the invention is, or comprises, or consists essentially of, or consists of, or involves or relates to such a protein from or as set forth in above Table 1A or Table 1B or a Cas13b effector protein of an organism set forth in Table 1A or Table 1B, as well as those proteins having 90, 91, 92, 93, 94, 95 96, 97, 98, 99 or 100 identity therewith, e.g., a protein having one or more changes within the foregoing percentages wherein the change is, comprises, consists essentially of or consists of a conservative substitution groups, wherein conservative substitution may be with reference to the following tabulation:

| Class | Name of the amino acids |
|---|---|
| Aliphatic | Glycine, Alanine, Valine, Leucine, Isoleucine |
| Hydroxyl or Sulfur/Selenium- containing | Serine, Cysteine, Selenocysteine, Threonine, Methionine |
| Cyclic | Proline |
| Aromatic | Phenylalanine, Tyrosine, Tryptophan |
| Basic | Histidine, Lysine, Arginine |
| Acidic and their Amide | Aspartate, Glutamate, Asparagine, Glutamine |

Or, with reference to knowledge in the art as to a conservative substitution, e.g., French et al. "What is a Conservative Substitution?", J. Molecular Evolution, 19(2): 171-175 (March 1983); Yampolsky et al., "The Exchangeability of Amino Acids in Proteins," Genetics 170(4): 1459-

Figure 1B:
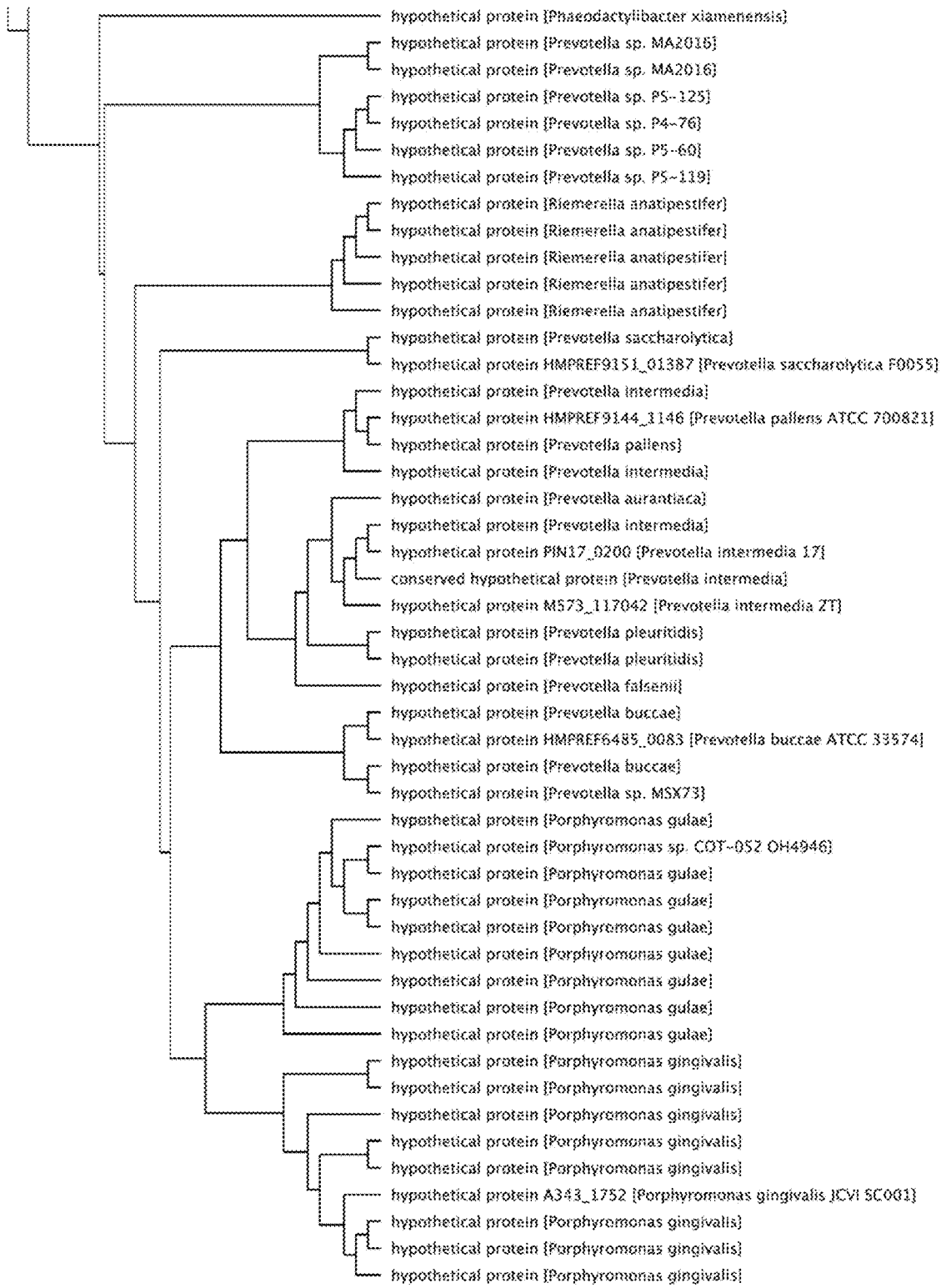

1472 (August 2005), doi: 10.1534/genetics.104.039107; Gemovic, "Feature-Based Classification of Amino Acid Substitutions outside Conserved Functional Protein Domains," The Scientific World Journal, Volume 2013 (2013), Article ID 948617, 10 pages dx.doi.org/10.1155/2013/948617. Also, a Table 1A or Table 1B Cas13b effector protein of the invention is, or comprises, or consists essentially of, or consists of, or involves or relates to such a protein from or as set forth in above Table 1A or Table 1B or a Cas13b effector protein of an organism set forth in Table 1A or Table 1B, including mutation, alteration or fusion as herein-discussed, as well as those proteins that includes mutation, alteration or fusion as herein-discussed and that either with or without consideration of such mutation, alteration or fusion has 90, 91, 92, 93, 94, 95 96, 97, 98, 99 or 100 identity with that set forth in Table 1A or Table 1B or a Cas13b effector protein of an organism set forth in Table 1A or Table 1B. In addition, a Table 1A or Table 1B Cas13b effector protein (that can include herein-discussed mutation, alteration or fusion and/or 90, 91, 92, 93, 94, 95 96, 97, 98, 99 or 100 identity with that set forth in Table 1A or Table 1B or a Cas13b effector protein of an organism set forth in Table 1A or Table 1B) can be a Cas13b effector protein having at least 85, 86, 87, 88, 89, 90, 91, 92, 93, 94, 95 96, 97, 98, 99 or 100 identity with that set forth in Table 1A or Table 1B or a Cas13b effector protein of an organism set forth in Table 1A or Table 1B and a similarity, homology or identity to a C2c2 protein of Table 3 as displayed between protein(s) of Table 1A or Table 1B and protein(s) of Table 3. See also FIG. 1, FIG. 2.

Example 2: Activity of Cas13b in Eukaryotic Cells

Figure 16:
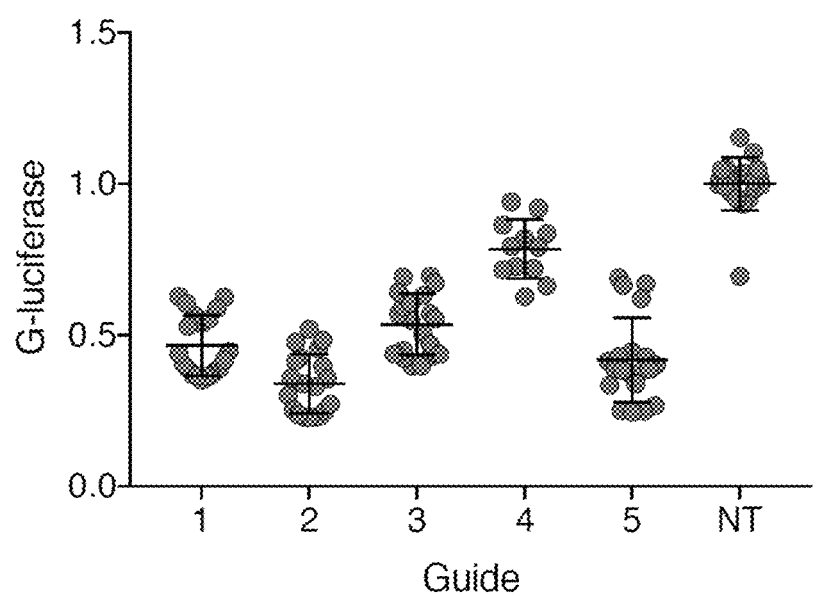
FIG. 16 shows the composite data from orthologs having significant activity in eukaryotic cells with the same guide sequences.
Figure 17A:
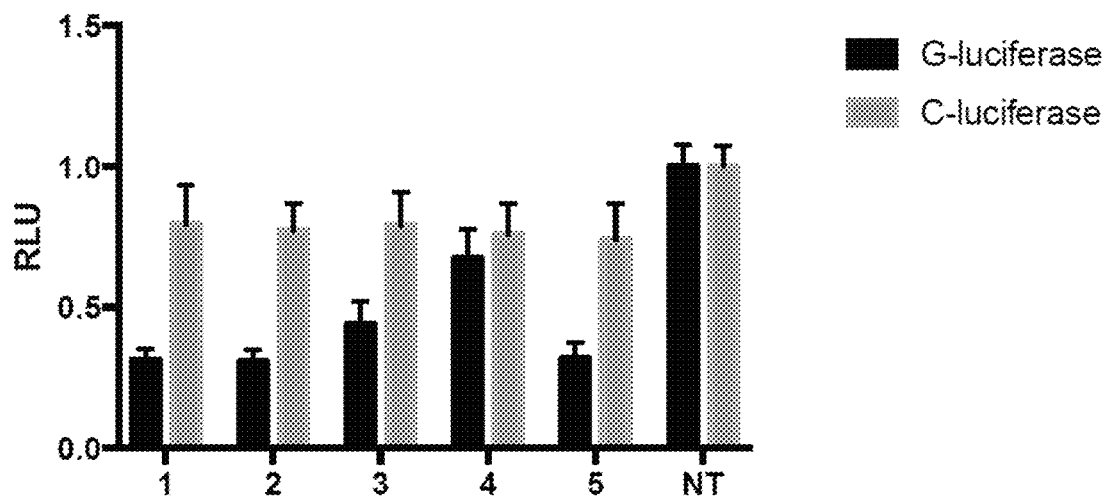
FIG. 17A-17G shows the collateral effect of the Cas13b orthologs in mammalian cells using two different reporter genes, G-luciferase and C-luciferase.
Figure 17B:
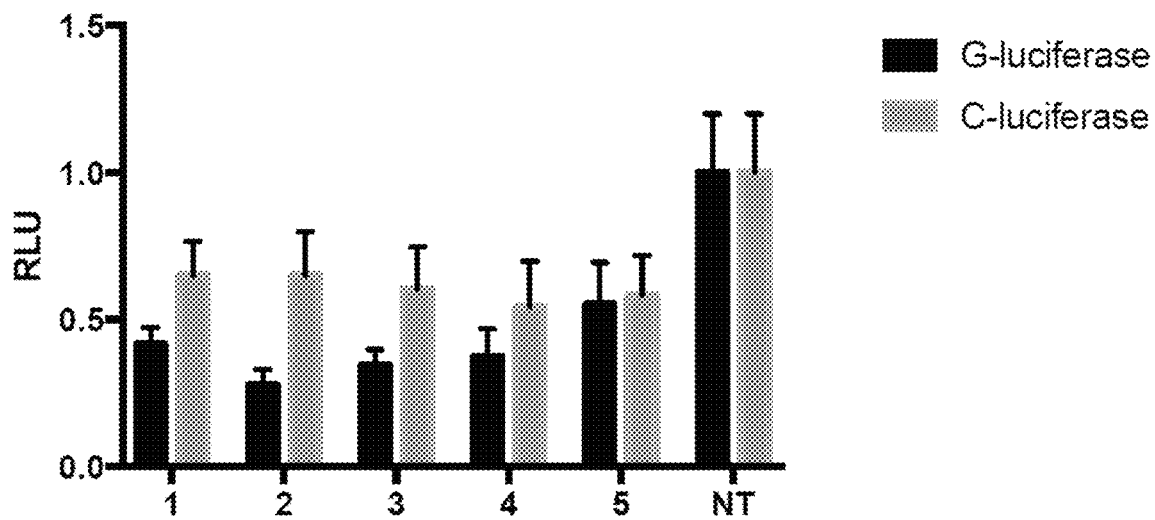
Figure 17C:
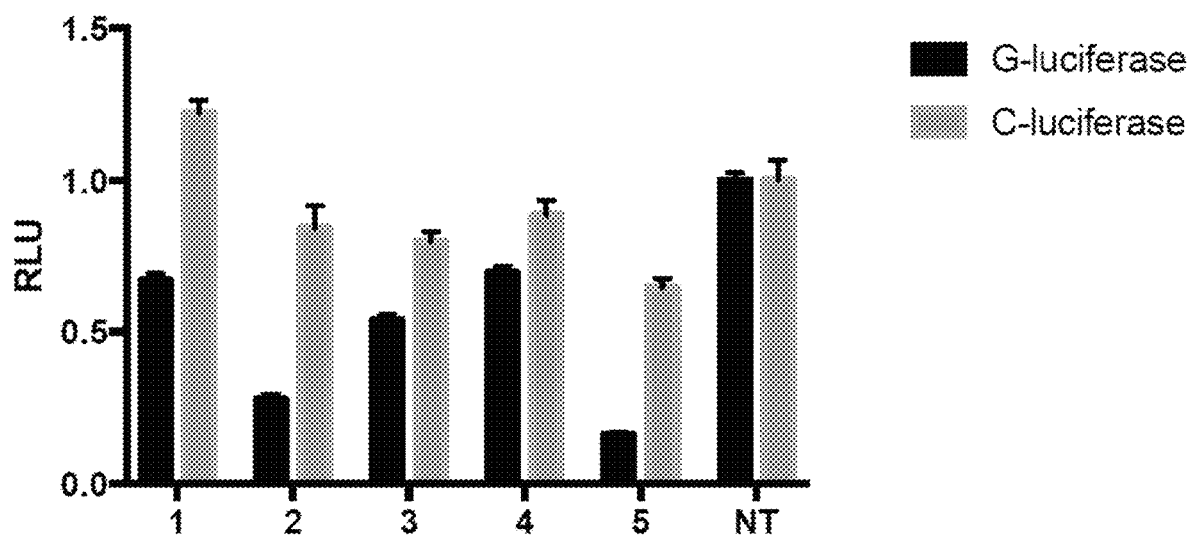
Figure 17D:
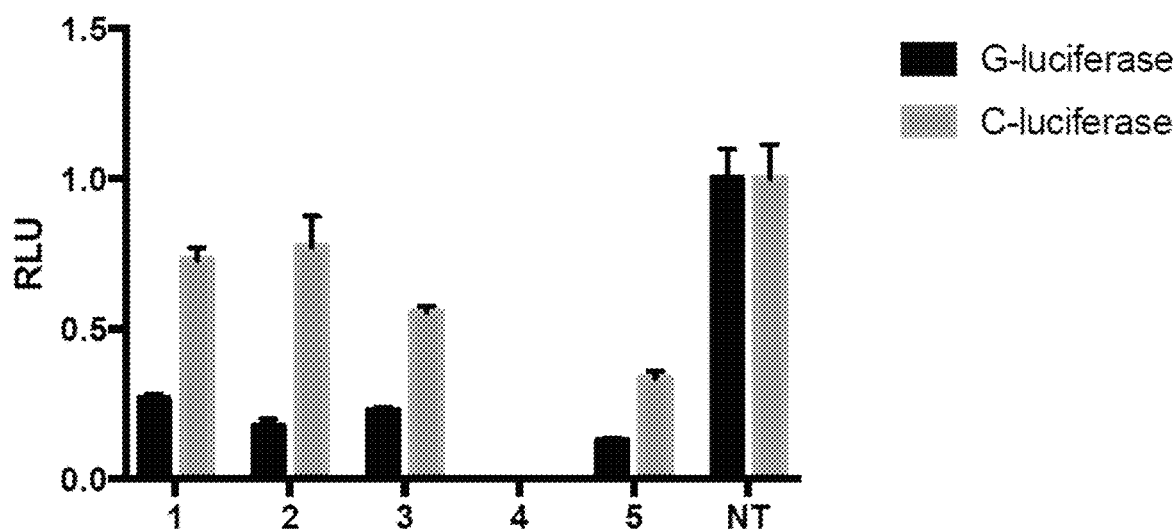
Figure 17E:
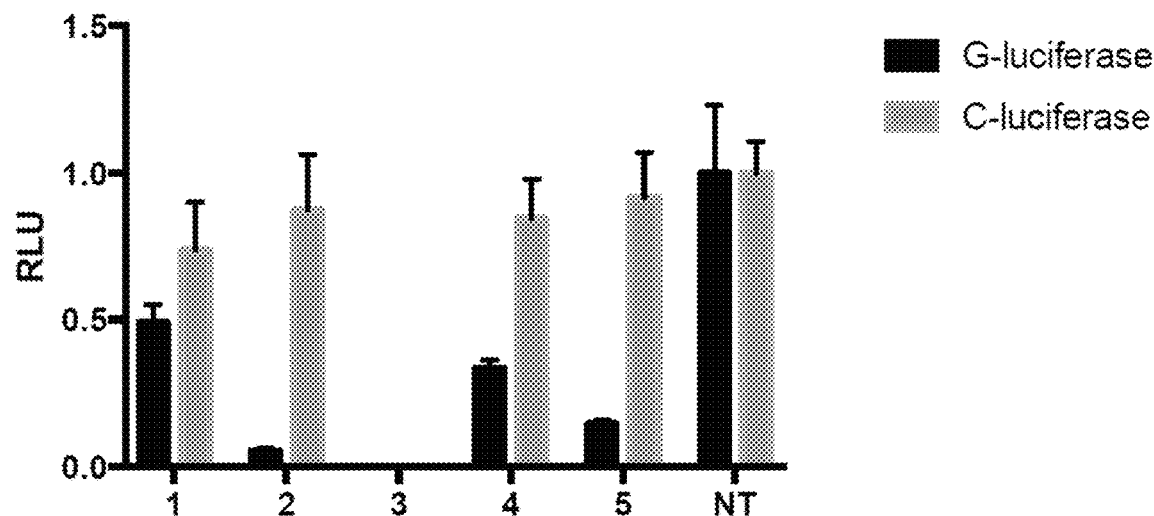
Figure 17F:
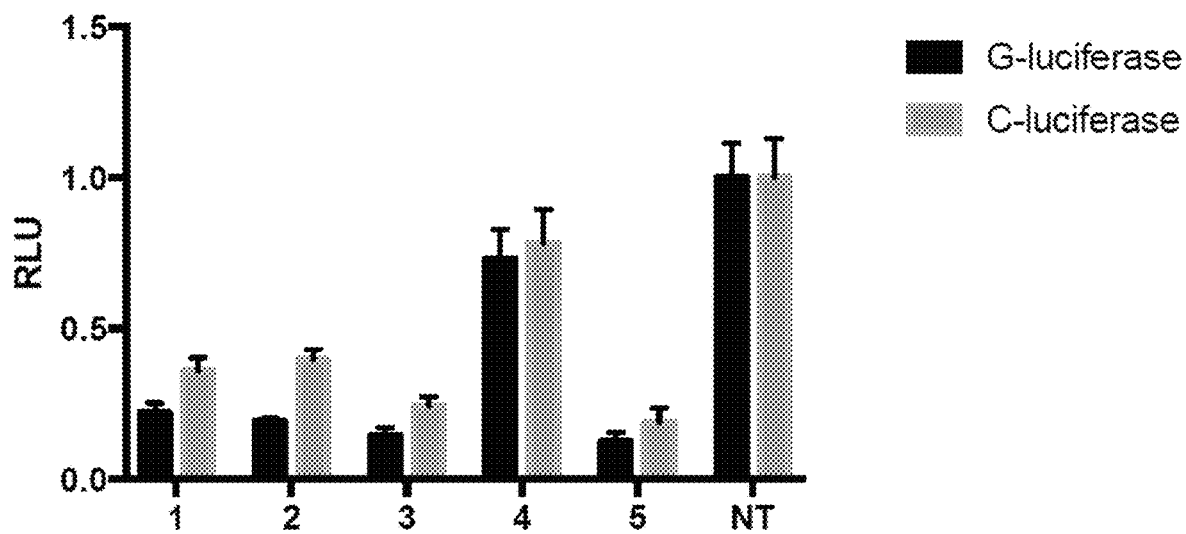
Figure 17G:
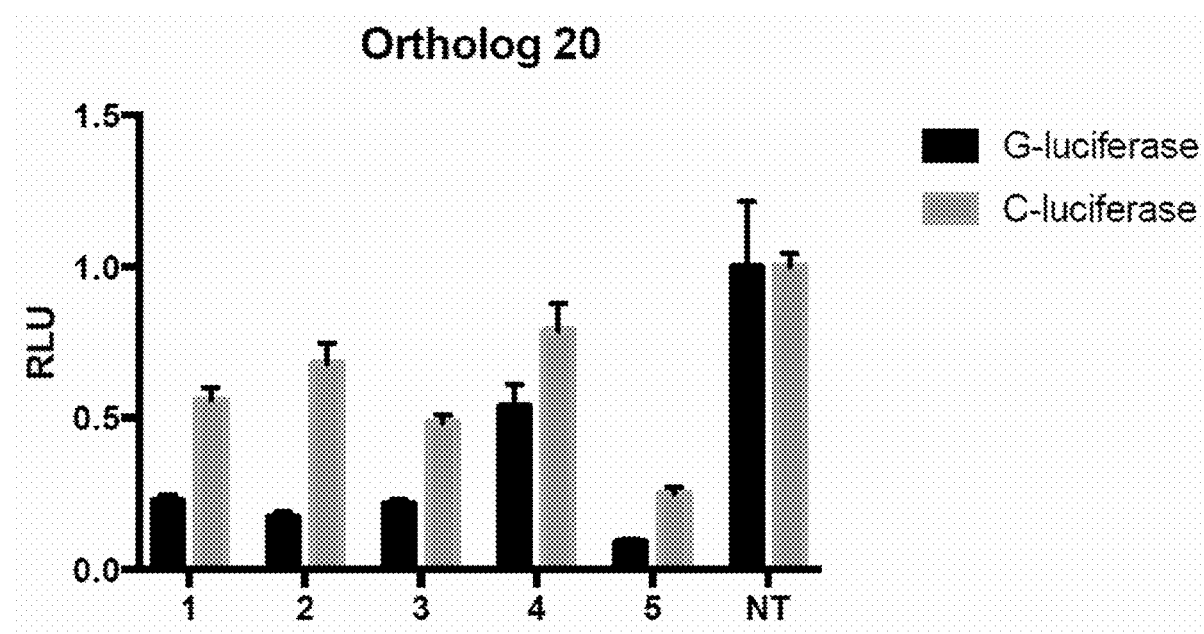
Figure 18:
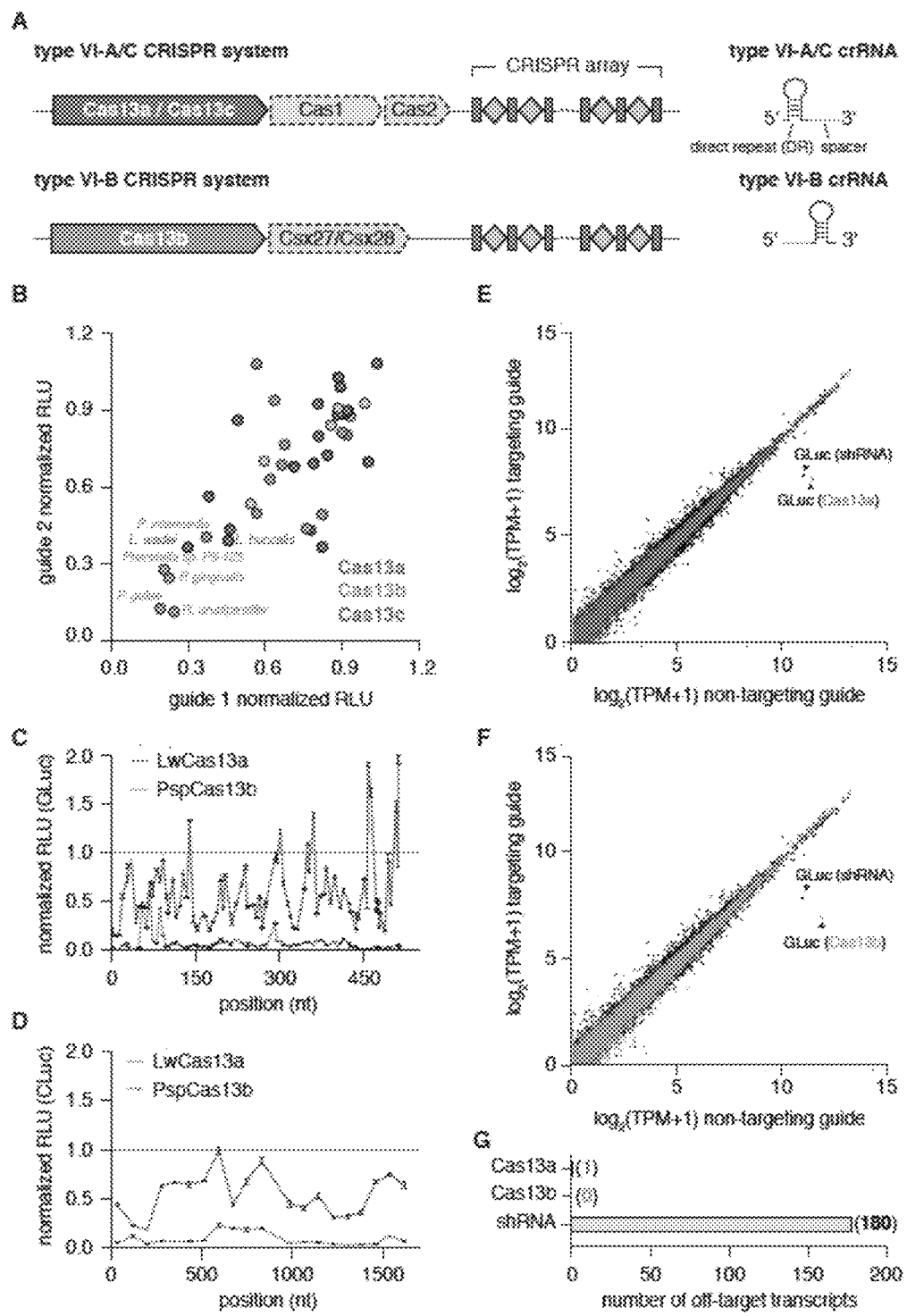
FIG. 18 shows characterization of a highly active Cas13b ortholog for RNA knockdown. A) Schematic of stereotypical Cas13 loci and corresponding crRNA structure. B) Evaluation of 19 Cas13a, 15 Cas13b, and 7 Cas13c orthologs for luciferase knockdown using two different guides. Orthologs with efficient knockdown using both guides are labeled with their host organism name. C) PspCas13b and LwaCas13a knockdown activity are compared by tiling guides against Gluc and measuring luciferase expression. D) PspCas13b and LwaCas13a knockdown activity are compared by tiling guides against Cluc and measuring luciferase expression. E) Expression levels in log 2 (transcripts per million (TPM)) values of all genes detected in RNA-seq libraries of non-targeting control (x-axis) compared to Gluc-targeting condition (y-axis) for LwaCas13a (red) and shRNA (black). Shown is the mean of three biological replicates. The Gluc transcript data point is labeled. F) Expression levels in log 2(transcripts per million (TPM)) values of all genes detected in RNA-seq libraries of non-targeting control (x-axis) compared to Gluc-targeting condition (y-axis) for PspCas13b (blue) and shRNA (black). Shown is the mean of three biological replicates. The Gluc transcript data point is labeled. G) Number of significant off-targets from Gluc knockdown for LwaCas13a, PspCas13b, and shRNA from the transcriptome wide analysis in E and F.
Figure 19:
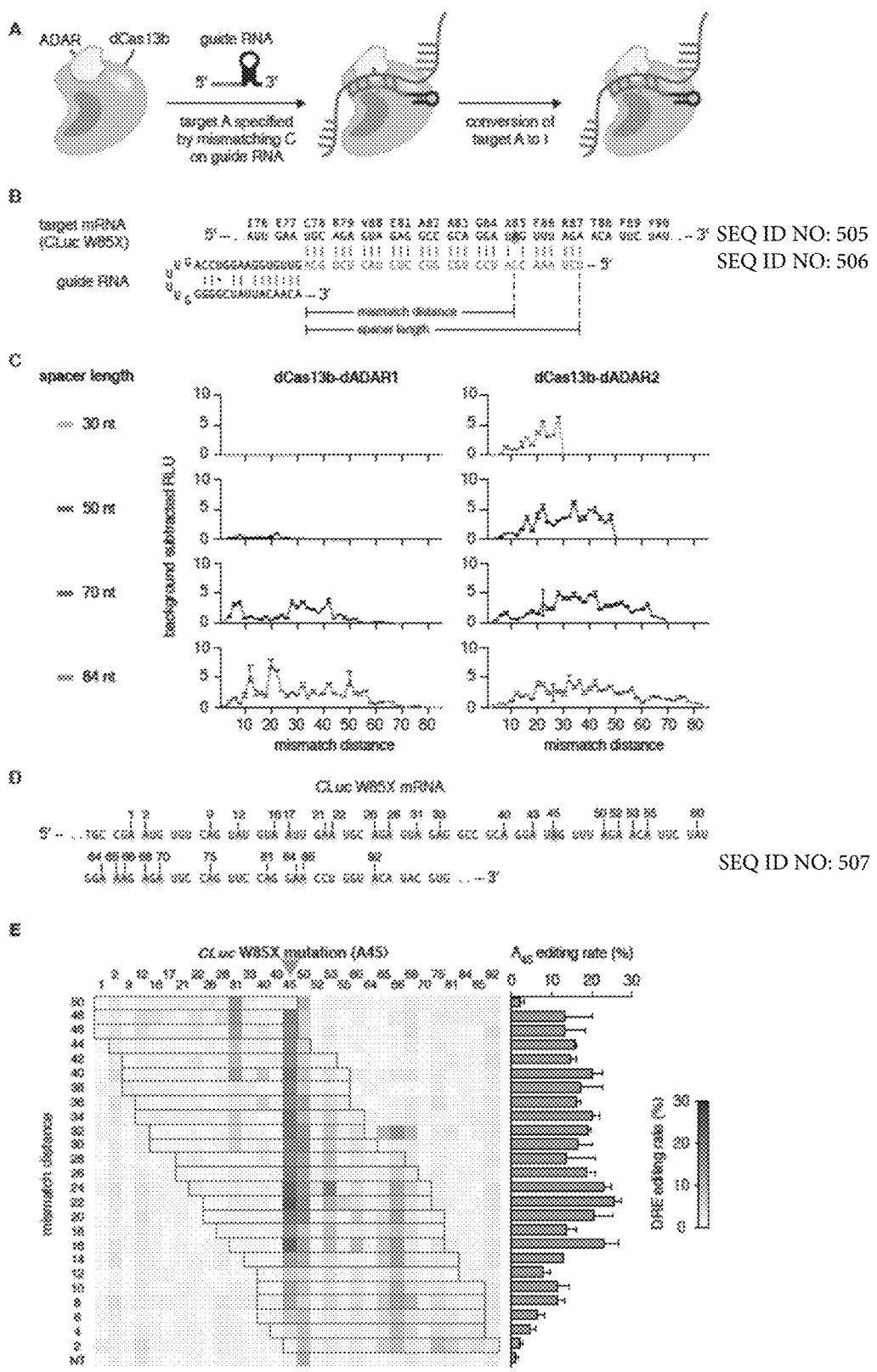
FIG. 19 shows engineering dCas13b-ADAR fusions for RNA editing. A) Schematic of RNA editing by dCas13b-ADAR fusion proteins. B) Schematic of *Cypridina* luciferase W85X target and targeting guide design. C) Quantification of luciferase activity restoration for Cas13b-dADAR1 (left) and Cas13b-ADAR2-cd (right) with tiling guides of length 30, 50, 70, or 84 nt. D) Schematic of target site for targeting *Cypridina* luciferase W85X. E) Sequencing quantification of A→I editing for 50 nt guides targeting *Cypridina* luciferase W85X.
Figure 20:
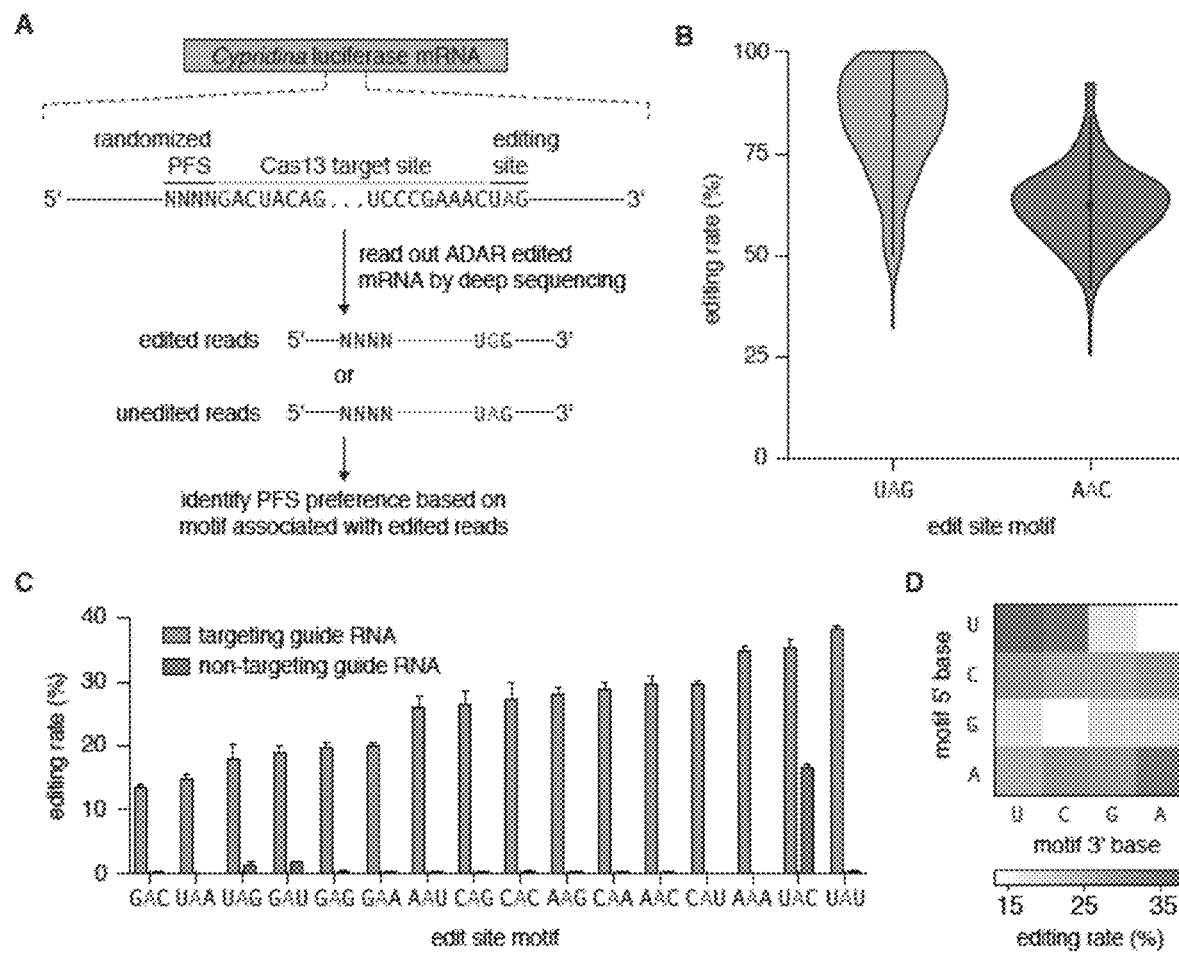
FIG. 20 shows measuring sequence flexibility for RNA editing by REPAIRv1. A) Schematic of screen for determining Protospacer Flanking Site (PFS) preferences of RNA editing by REPAIRv1. B) Distributions of RNA editing efficiencies for all 4-N PFS combinations at two different editing sites C) Quantification of the percent editing of REPAIRv1 at Cluc W85 across all possible 3 base motifs. D) Heatmap of 5' and 3' base preferences of RNA editing at Cluc W85 for all possible 3 base motifs.
Figure 21:
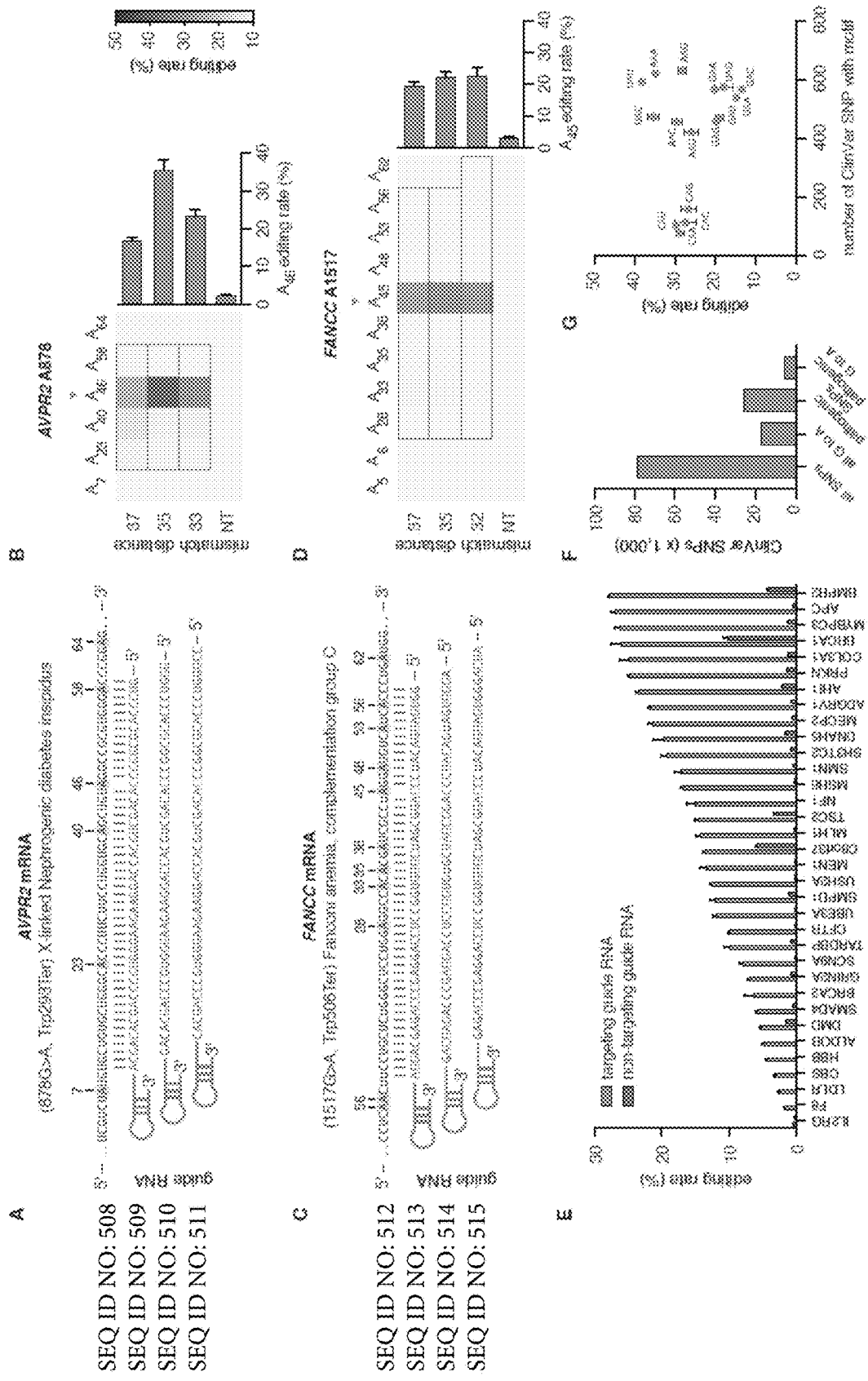
FIG. 21 shows correction of disease-relevant mutations with REPAIRv1. A) Schematic of target and guide design for targeting AVPR2 878G>A. B) The 878G>A mutation in AVPR2 is corrected to varying percentages using REPAIRv1 with three different guide designs. C) Schematic of target and guide design for targeting FANCC 1517G>A. D) The 1517G>A mutation in FANCC is corrected to varying percentages using REPAIRv1 with three different guide designs. E) Quantification of the percent editing of 34 different disease-relevant G>A mutations using REPAIRv1. F) Analysis of all the possible G>A mutations that could be corrected as annotated by the ClinVar database. G) The distribution of editing motifs for all G>A mutations in ClinVar is shown versus the editing efficiency by REPAIRv1 per motif as quantified on the Gluc transcript.
Figure 22:
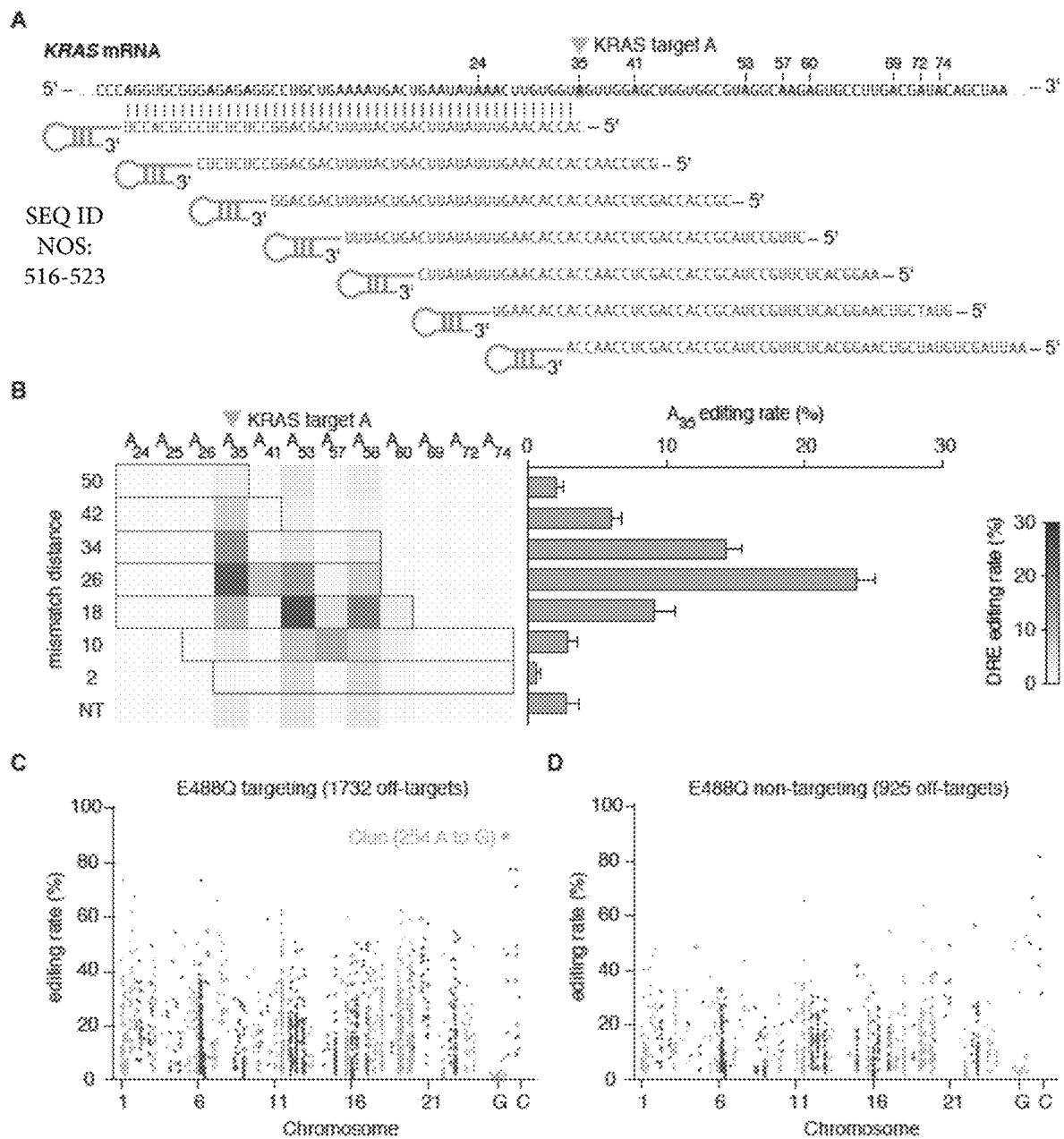
FIG. 22 shows characterizing specificity of REPAIRv1. A) Schematic of KRAS target site and guide design. B) Quantification of percent editing for tiled KRAS-targeting guides. Editing percentages are shown at the on-target and neighboring adenosine sites. For each guide, the region of duplex RNA is indicated by a red rectangle. C) Transcriptome-wide sites of significant RNA editing by REPAIRv1 with Cluc targeting guide. The on-target site Cluc site (254 A>G) is highlighted in orange. D) Transcriptome-wide sites of significant RNA editing by REPAIRv1 with non-targeting guide.
Figure 23:
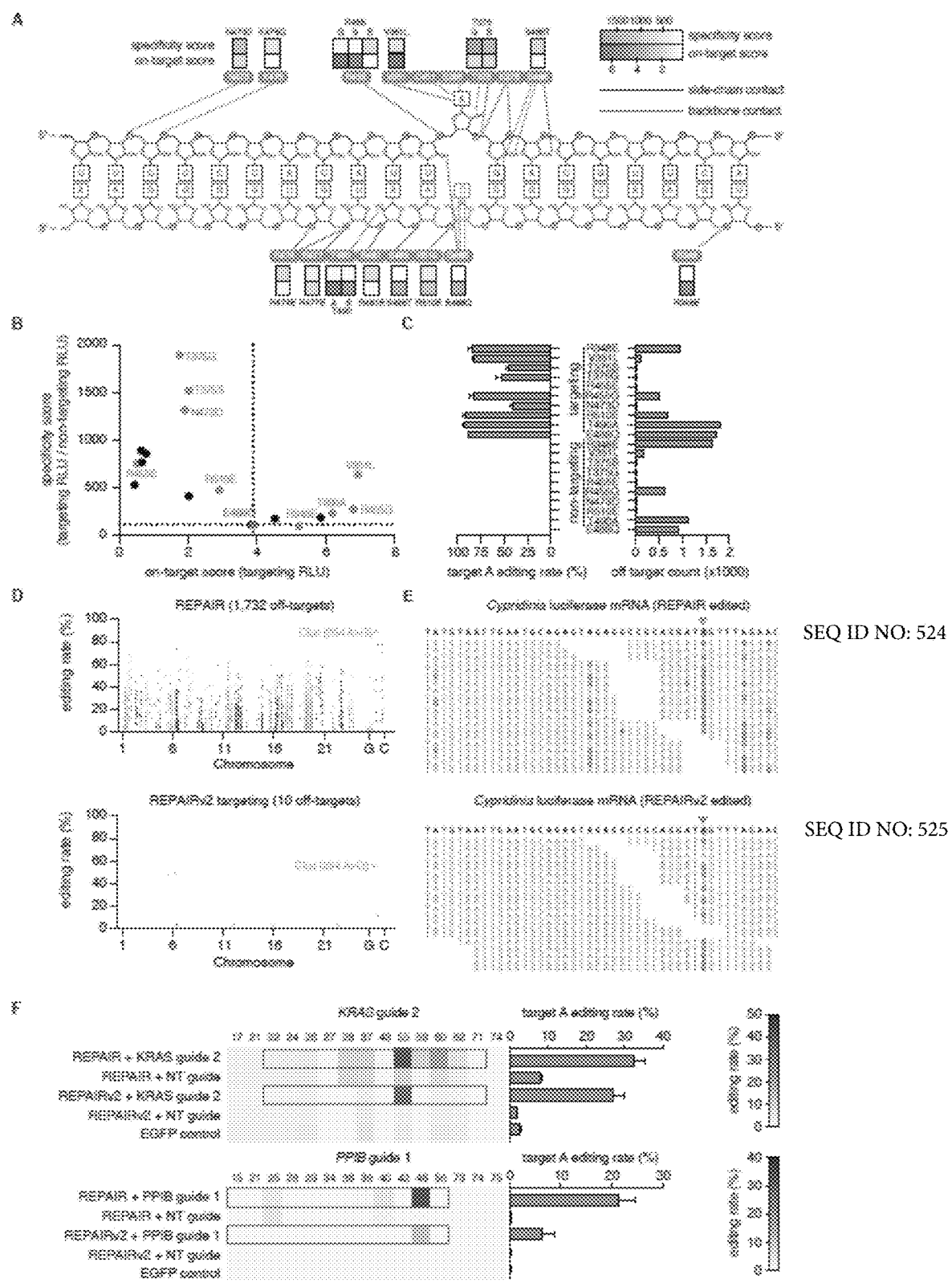
FIG. 23 shows rational mutagenesis of ADAR2 to improve the specificity of REPAIRv1. A) Quantification of luciferase signal restoration by various dCas13-ADAR2 mutants as well as their specificity score plotted along a schematic for the contacts between key ADAR2 deaminase residues and the dsRNA target. The specificity score is defined as the ratio of the luciferase signal between targeting guide and non-targeting guide conditions. B) Quantification of luciferase signal restoration by various dCas13-ADAR2 mutants versus their specificity score. C) Measurement of the on-target editing fraction as well as the number of significant off-targets for each dCas13-ADAR2 mutant by transcriptome wide sequencing of mRNAs. D) Transcriptome-wide sites of significant RNA editing by REPAIRv1 and REPAIRv2 with a guide targeting a pretermination site in Cluc. The on-target Cluc site (254 A>G) is highlighted in orange. E) RNA sequencing reads surrounding the on-target Cluc editing site (254 A>G) highlighting the differences in off-target editing between REPAIRv1 and REPAIRv2. All A>G edits are highlighted in red while sequencing errors are highlighted in blue. F) RNA editing by REPAIRv1 and REPAIRv2 with guides targeting an out-of-frame UAG site in the endogenous KRAS and PPIB transcripts. The on-target editing fraction is shown as a sideways bar chart on the right for each condition row. The duplex region formed by the guide RNA is shown by a red outline box.
Figure 24:
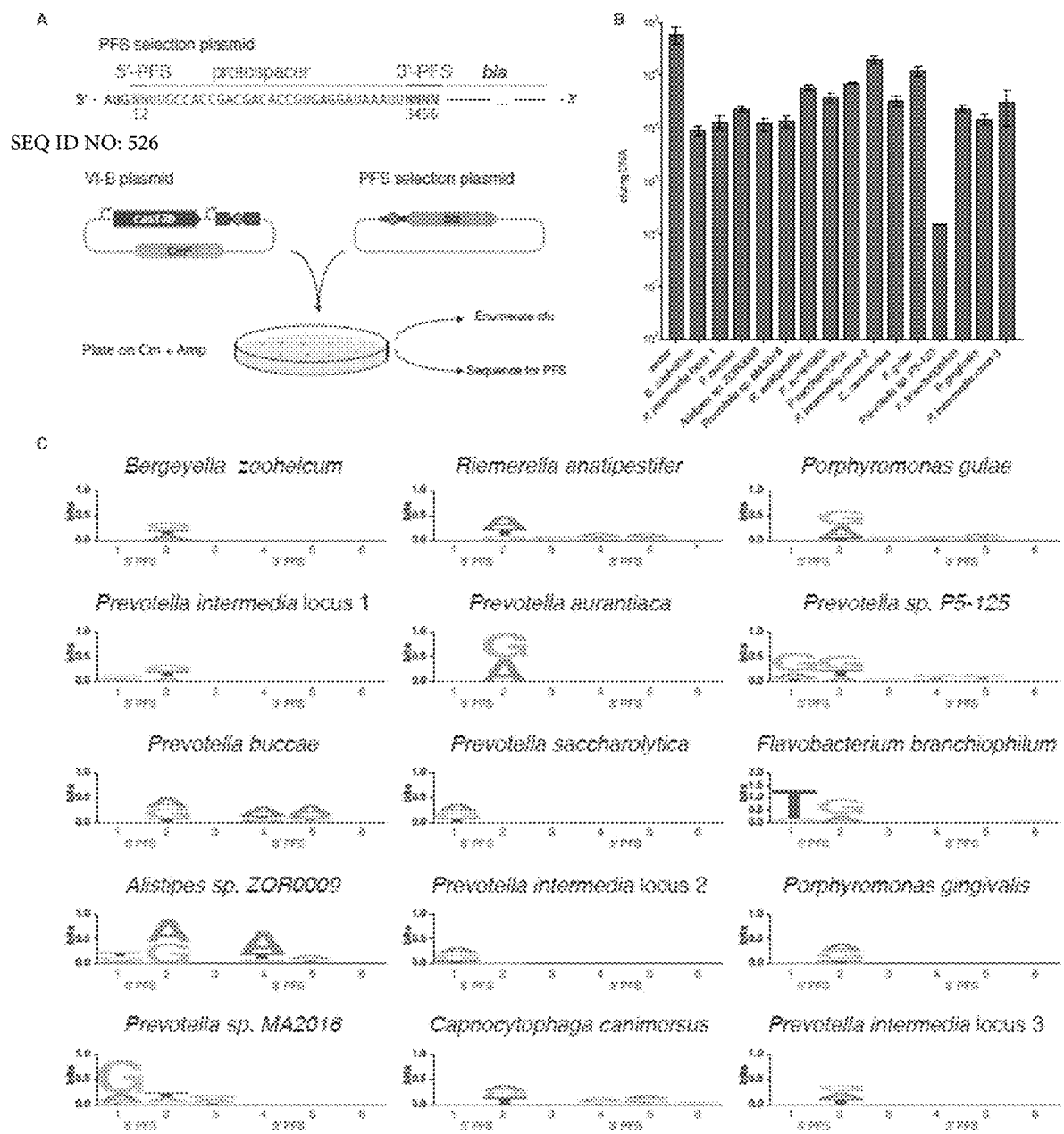
FIG. 24 shows bacterial screening of Cas13b orthologs for in vivo efficiency and PFS determination. A) Schematic of bacterial assay for determining the PFS of Cas13b orthologs. Cas13b orthologs with beta-lactamase targeting spacers are co-transformed with beta-lactamase expression plasmids and subjected to double selection. B) Quantitation of interference activity of Cas13b orthologs targeting beta-lactamase as measured by colony forming units (cfu). C) PFS logos for Cas13b orthologs as determined by depleted sequences from the bacterial assay.
Figure 25:
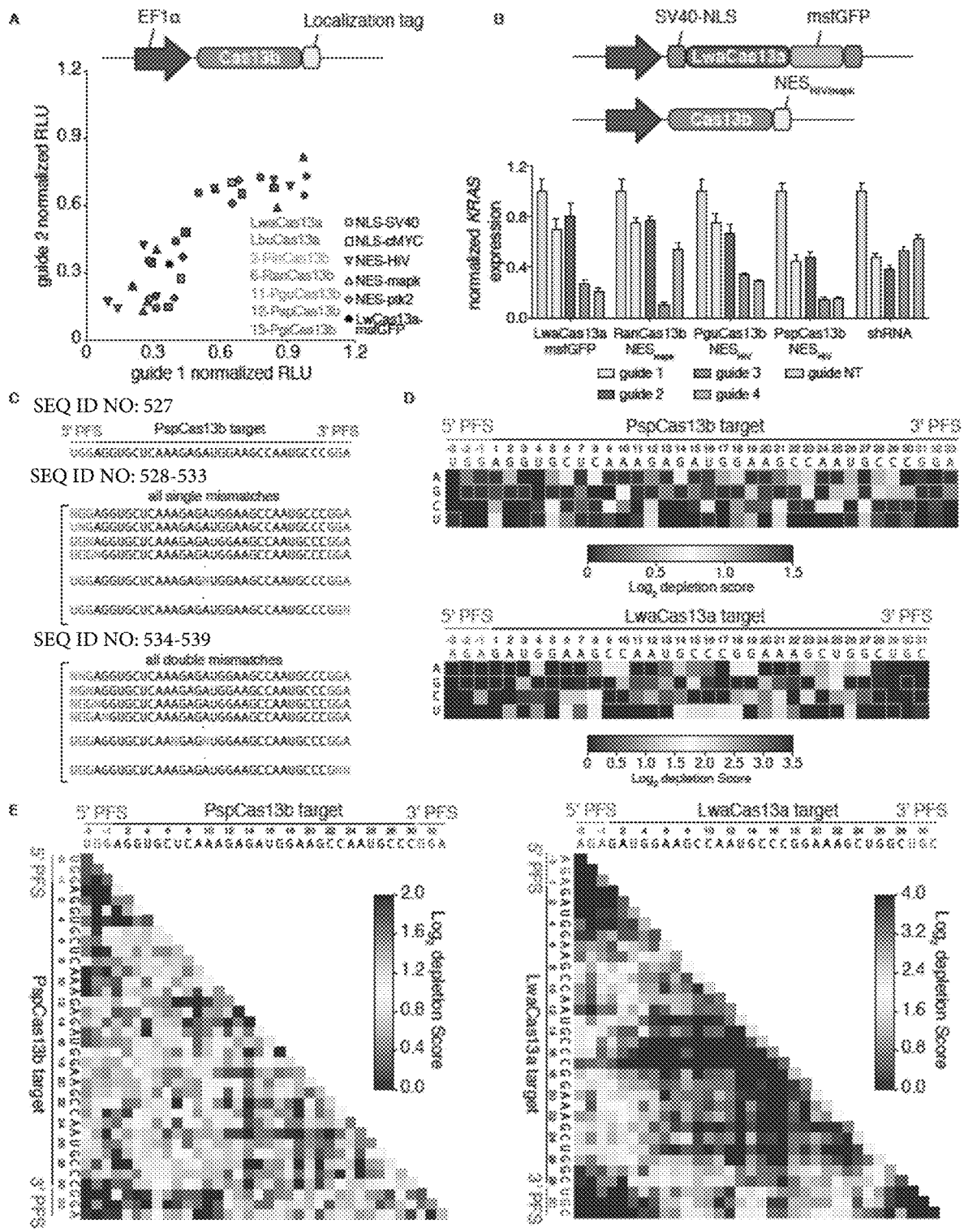
FIG. 25 shows optimization of Cas13b knockdown and further characterization of mismatch specificity. A) Gluc knockdown with two different guides is measured using the top 2 Cas13a and top 4 Cas13b orthologs fused to a variety of nuclear localization and nuclear export tags. B) Knockdown of KRAS is measured for LwaCas13a, RanCas13b, PguCas13b, and PspCas13b with four different guides and compared to four position-matched shRNA controls. C) Schematic of the single and double mismatch plasmid libraries used for evaluating the specificity of LwaCas13a and PspCas13b knockdown. Every possible single and double mismatch is present in the target sequence as well as in 3 positions directly flanking the 5' and 3' ends of the target site. D) The depletion level of transcripts with the indicated single mismatches are plotted as a heatmap for both the LwaCas13a and PspCas13b conditions. E) The depletion level of transcripts with the indicated double mismatches are plotted as a heatmap for both the LwaCas13a and PspCas13b conditions.
Figure 26:
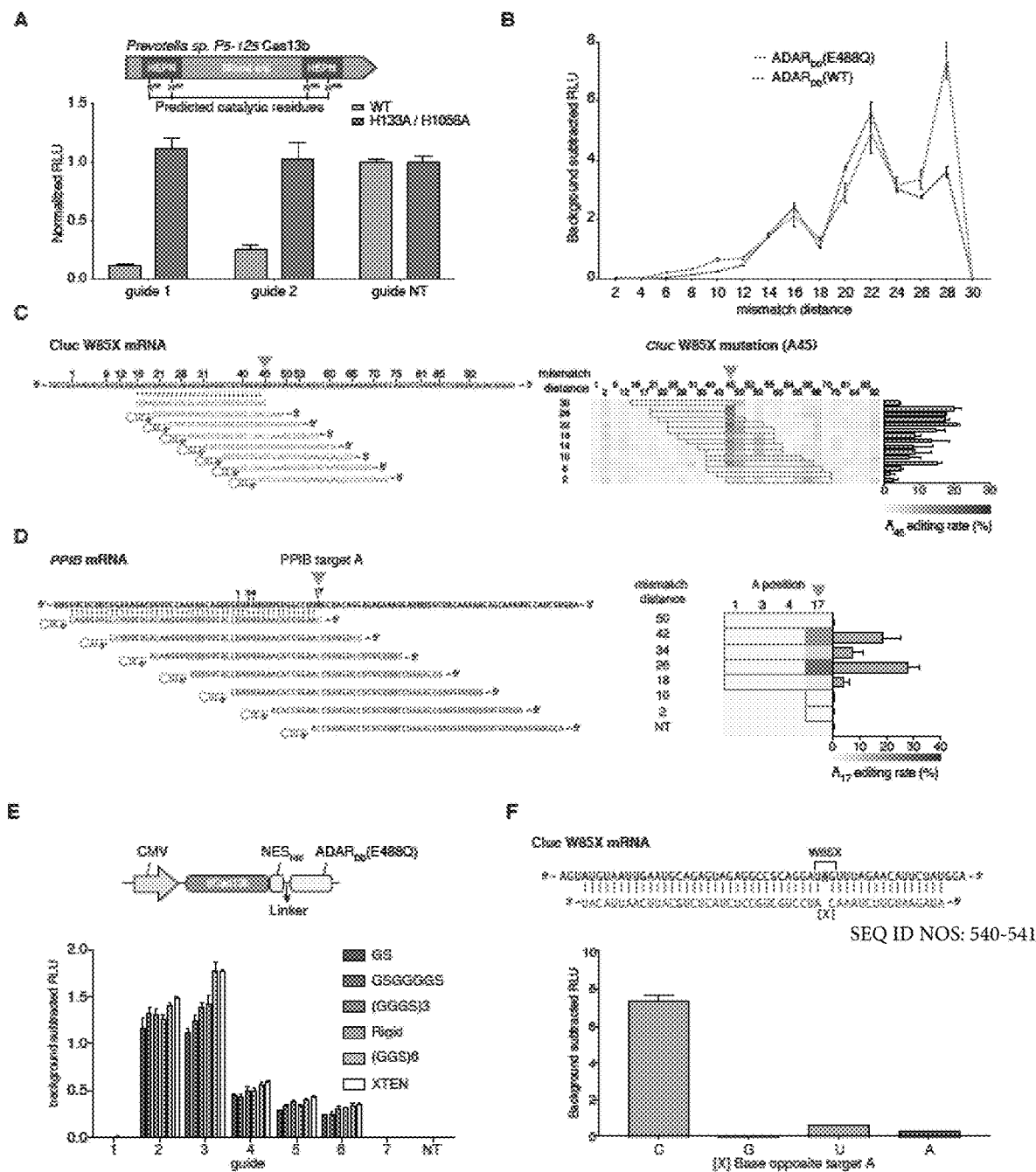
FIG. 26 shows characterization of design parameters for dCas13-ADAR2 RNA editing. A) Knockdown efficiency of Gluc targeting for wildtype Cas13b and catalytically inactive H133A/H1058A Cas13b (dCas13b). B) Quantification of luciferase activity restoration by dCas13b fused to either the wildtype ADAR2 catalytic domain or the hyperactive E488Q mutant ADAR2 catalytic domain, tested with tiling Cluc targeting guides. C) Guide design and sequencing quantification of A→I editing for 30 nt guides targeting Cypridinia luciferase W85X. D) Guide design and sequencing quantification of A→I editing for 50 nt guides targeting PP IB. E) Influence of linker choice on luciferase activity restoration by REPAIRv1. F) Influence of base identify opposite the targeted adenosine on luciferase activity restoration by REPAIRv1.
Figure 27:
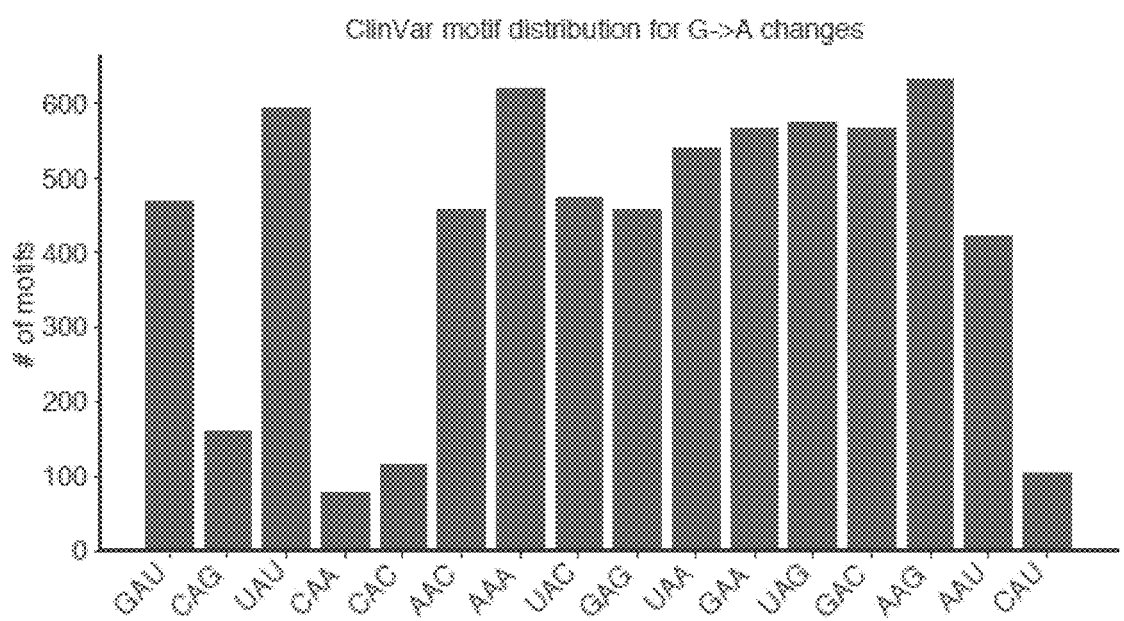
FIG. 27 shows clinVar motif distribution for G>A mutations. The number of each possible triplet motif observed in the ClinVar database for all G>A mutations.

A luciferase targeting assay was performed with different gRNAs directed against Gluc. Cas13b orthologues are fused to an NLS or NES or alternatively were not fused to a localization signal. Normalized protein expression of luciferase was determined and compared to non targeting (NT) gRNA. The results for the different Cas13b orthologs are provided in FIGS. 11-15. In FIG. 16, the composite data from the most active orthologs with the same guide are compiled. It was found that the Cas13b orthologs from *Bacteroides pyogenes, Prevotella* sp. MA2016, *Riemerella anatipestifer, Porphyromonas gulae, Porphyromonas gingivalis,* and *Porphyromonas* sp.COT-0520H4946 are particularly active in eukaryotic cells.

Example 3: C2c2 Orthologues

Figure 2A:
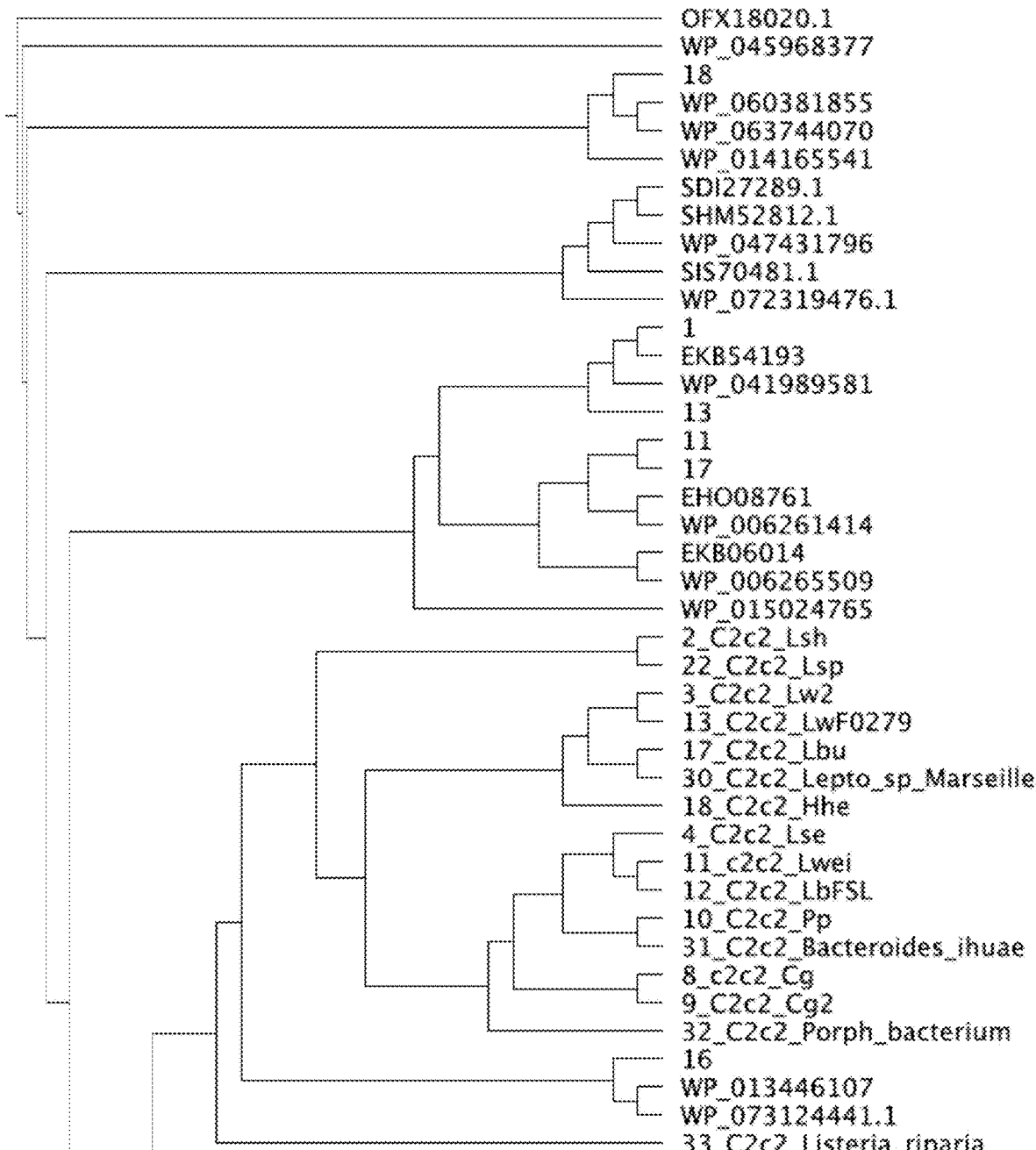
FIG. 2A-2C shows a tree alignment of C2c2 and Cas13b orthologs.
Figure 2B:
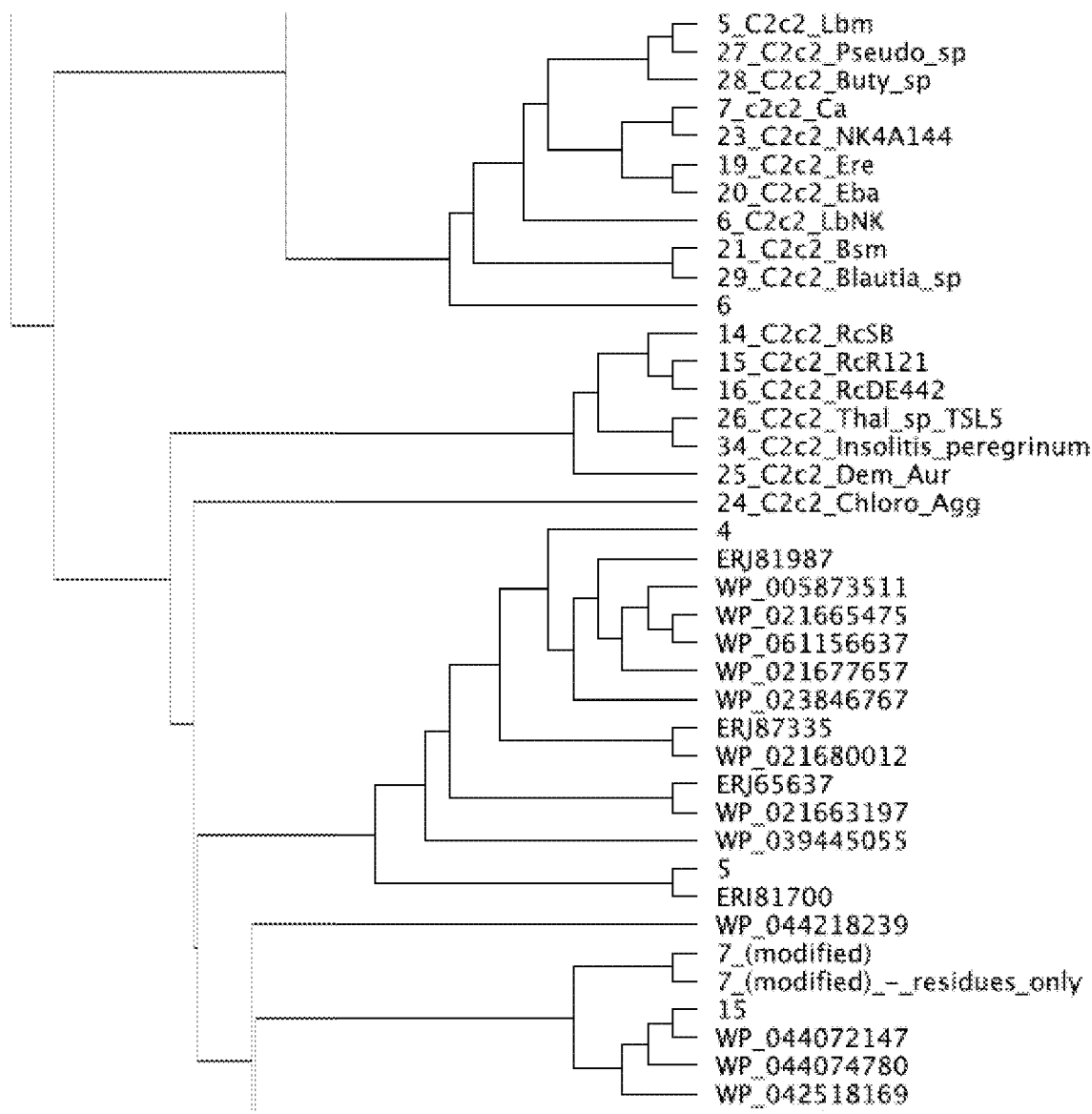
Figure 2C:
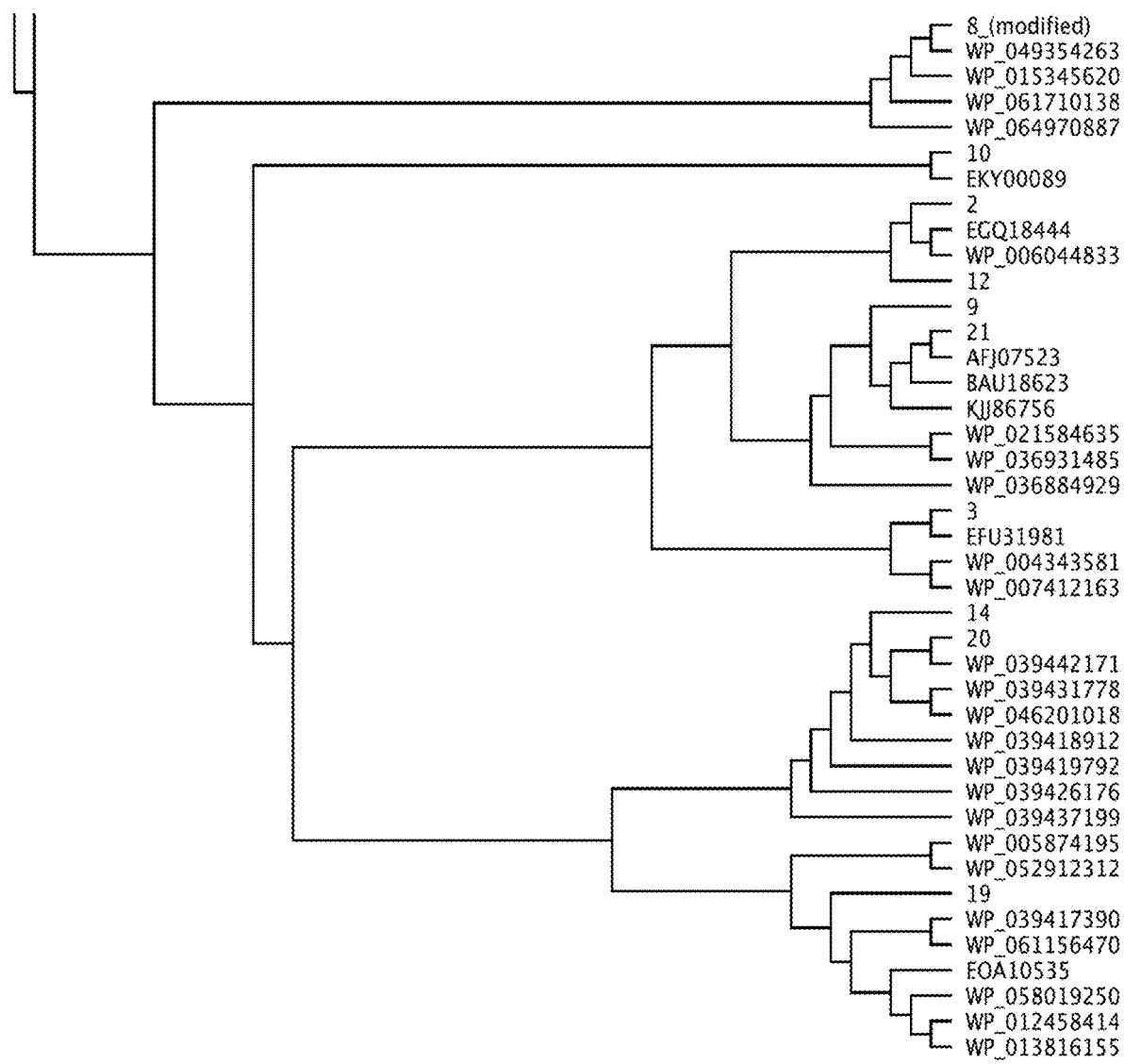
Figure 3:
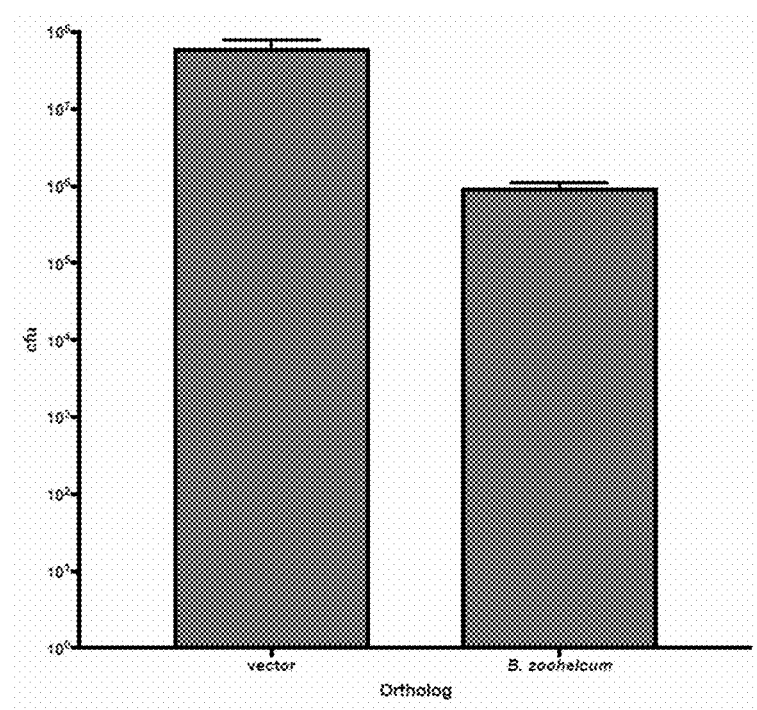
FIG. 3 shows an exemplary result of the testing of Cas13b orthologs for activity in *E. Coli*, whereby the introduction of Cas13b from *B. zoohelcum* is compared to the introduction of an empty vector.
Figure 4:
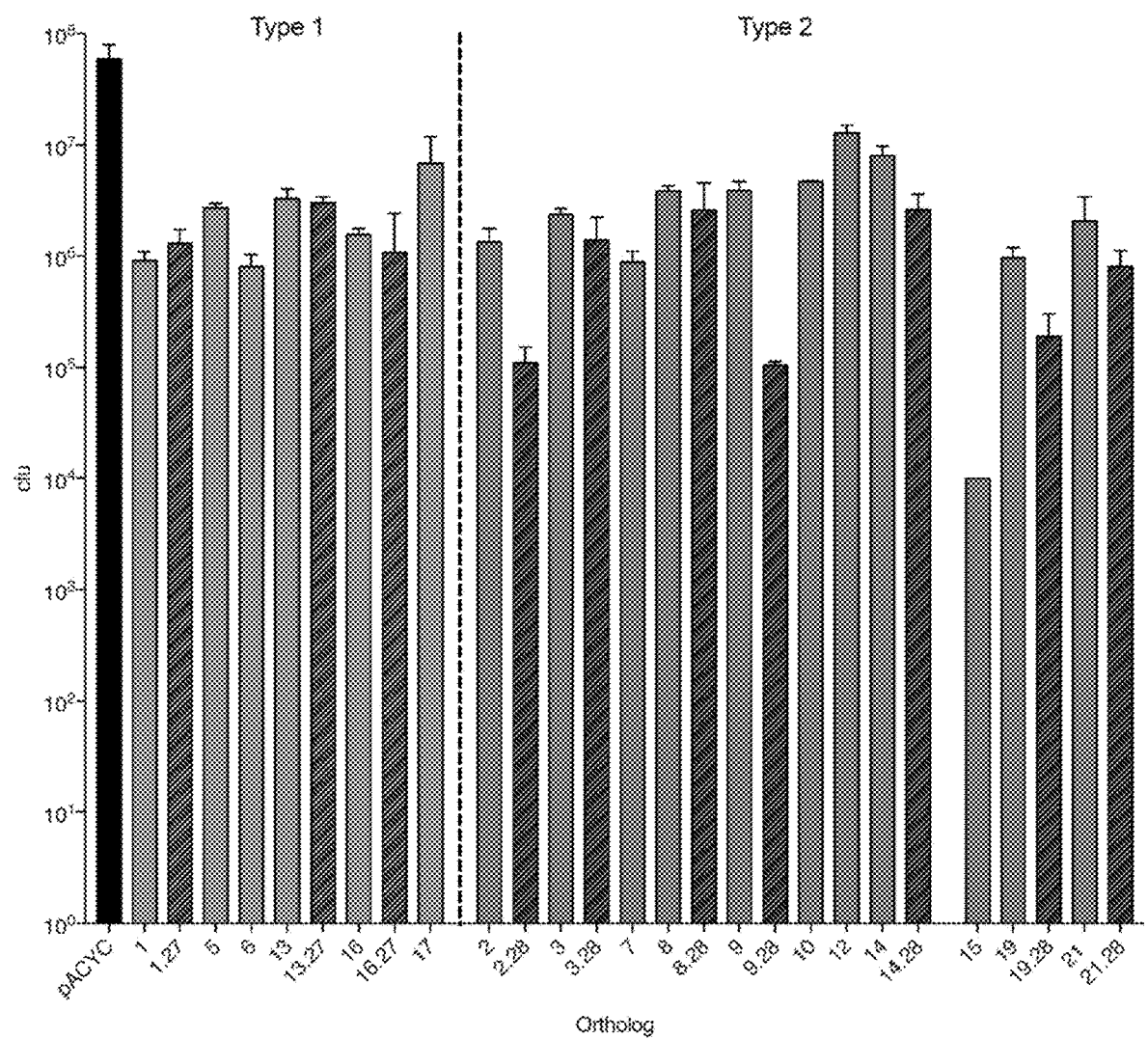
FIG. 4 shows a general comparison of the specific RNA cleavage activity obtained with the different orthologs of Table 1A or Table 1B.
Figure 5:
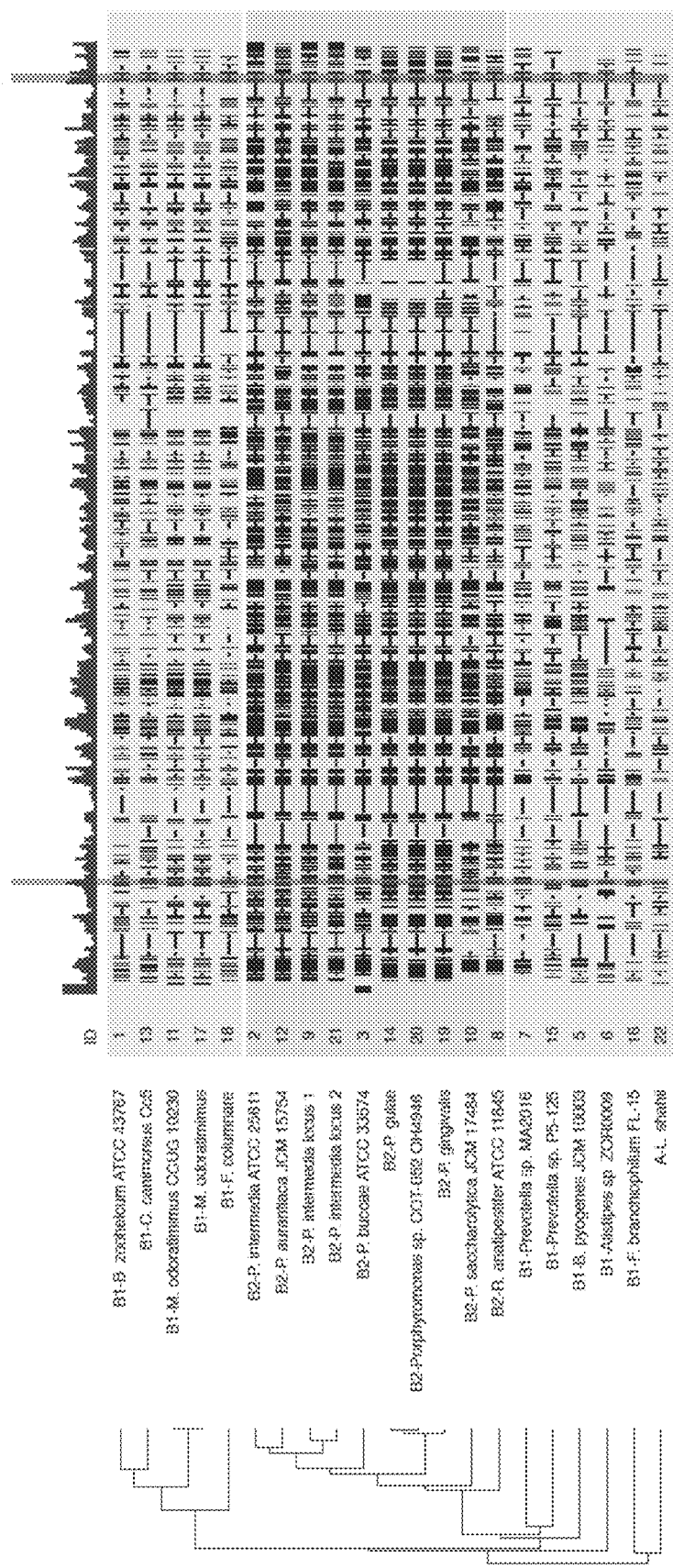
FIG. 5 shows an alignment of different Cas13b orthologs as provided in FIGS. 1 and 2.

Certain Cas13b orthologs are surprisingly similar to C2c2. FIG. 2 provides a tree alignment of C2c2 and Cas13b proteins.

TABLE 2

C2c2 Orthologues Similar to Cas13b Proteins

| C2c2 orthologue | Code | Multi Letter |
|---|---|---|
| *Leptotrichia shahii* | C2-2 | Lsh |
| *L wadei* F0279 (Lw2) | C2-3 | Lw2 |
| *Listeria seeligeri* | C2-4 | Lse |
| Lachnospiraceae bacterium MA2020 | C2-5 | LbM |
| Lachnospiraceae bacterium NK4A179 | C2-6 | LbNK179 |
| [*Clostridium*] *aminophilum* DSM 10710 | C2-7 | Ca |
| *Carnobacterium gallinarum* DSM 4847 | C2-8 | Cg |
| *Carnobacterium gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| Listeriaceae bacterium FSL M6-0635 | C2-12 | LbFSL |
| *Leptotrichia wadei* F0279 | C2-13 | Lw |
| *Rhodobacter capsulatus* SB 1003 | C2-14 | Rc |
| *Rhodobacter capsulatus* R121 | C2-15 | Rc |
| *Rhodobacter capsulatus* DE442 | C2-16 | Rc |
| *Leptotrichia buccalis* C-1013-b | C2-17 | Lbu |
| *Herbinix hemicellulosilytica* | C2-18 | Hhe |
| [*Eubacterium*] *rectale* | C2-19 | Ere |
| Eubacteriaceae bacterium CHKCI004 | C2-20 | Eba |
| *Blautia* sp. Marseille-P2398 | C2-21 | BSm |
| *Leptotrichia* sp. oral taxon 879 str. F0557 | C2-22 | Lsp |
| Lachnospiraceae bacterium NK4A144 | C2-23 | NK4A144 |
| RNA-binding protein S1 *Chloroflexus aggregans* | C2-24 | |
| *Demequina aurantiaca* | C2-25 | |
| *Thalassospira* sp. TSL5-1 | C2-26 | |
| SAMN04487830_13920 *Pseudobutyrivibrio* sp. OR37 | C2-27 | |
| SAMN02910398_00008 *Butyrivibrio* sp. YAB3001 | C2-28 | |
| *Blautia* sp. Marseille-P2398 | C2-29 | |
| *Leptotrichia* sp. Marseille-P3007 | C2-30 | |
| *Bacteroides ihuae* | C2-31 | |
| SAMN05216357_1045 Porphyromonadaceae bacterium KH3CP3RA | C2-32 | |
| *Listeria riparia* | C2-33 | |
| *Insolitispirillum peregrinum* | C2-34 | |

The protein sequences of the above C2c2 species are listed in the Table 3 below.

TABLE 3

Sequences of C2c2 Species Herein-Identified (See Table 2, Above)

| | | | |
|---|---|---|---|
| c2c2-5 | 1 | Lachnospiraceae bacterium MA2020 | MQISKVNHKHVAVGQKDRERITGFIYNDPVGDEKSLEDVVA KRANDTKVLFNVFNTKDLYDSQESDKSEKDKEIISKGAKFV AKSENSAITILKKQNKIYSTLTSQQVIKELKDKEGGARIYDDD IEEALTETLKKSFRKENVRNSIKVLIENAAGIRSSLSKDEEELI QEYFVKQLVEEYTKTKLQKNVVKSIKNQNMVIQPDSDSQVL SLSESRREKQSSAVSSDTLVNCKEKDVLKAFLTDYAVLDEDE RNSLLWKLRNLVNLYFYGSESIRDYSYTKEKSVWKEHDEQK ANKTLFIDEICHITKIGKNGKEQKVLDYEENRSRCRKQNINY YRSALNYAKNNTSGIFENEDSNHFWIHLIENEVERLYNGIEN GEEFKFETGYISEKVWKAVINHLSIKYIALGKAVYNYAMKEL SSPGDIEPGKIDDSYINGITSFDYEIIKAEESLQRDISMNVVFAT NYLACATVDTDKDFLLFSKEDIRSCTKKDGNLCKNIMQFWG GYSTWKNFCEEYLKDDKDALELLYSLKSMLYSMRNSSFHFS TENVDNGSWDTELIGKLFEEDCNRAARIEKEKFYNNNLHMF YSSSLLEKVLERLYSSHHERASQVPSFNRVFVRKNFPSSLSEQ RITPKFTDSKDEQIWQSAVYYLCKEIYYNDFLQSKEAYKLFR |

TABLE 3-continued

Sequences of C2c2 Species Herein-Identified (See Table 2, Above)

|  |  |  |  |
|---|---|---|---|
|  |  |  | EGVKNLDKNDINNQKAADSFKQAVVYYGKAIGNATLSQVC<br>QAIMTEYNRQNNDGLKKKSAYAEKQNSNKYKHYPLFLKQV<br>LQSAFWEYLDENKEIYGFISAQIHKSNVEIKAEDFIANYSSQQ<br>YKKLVDKVKKTPELQKWYTLGRLINPRQANQFLGSIRNYVQ<br>FVKDIQRRAKENGNPIRNYYEVLESDSIIKILEMCTKLNGTTS<br>NDIHDYFRDEDEYAEYISQFVNFGDVHSGAALNAFCNSESEG<br>KKNGIYYDGINPIVNRNWVLCKLYGSPDLISKITSRVNENMIH<br>DFHKQEDLIREYQIKGICSNKKEQQDLRTFQVLKNRVELRDI<br>VEYSEIINELYGQLIKWCYLRERDLMYFQLGFHYLCLNNASS<br>KEADYIKINVDDRNISGAILYQIAAMYINGLPVYYKKDDMY<br>VALKSGKKASDELNSNEQTSKKINYFLKYGNNILGDKKDQL<br>YLAGLELFENVAEHENIIIFRNEIDHFHYFYDRDRSMLDLYSE<br>VFDRFFTYDMKLRKNVVNMLYNILLDHNIVSSFVFETGEKK<br>VGRGDSEVIKPSAKIRLRANNGVSSDVFTYKVGSKDELKIAT<br>LPAKNEEFLLNVARLIYYPDMEAVSENMVREGVVKVEKSND<br>KKGKISRGSNTRSSNQSKYNNKSKNRMNYSMGSIFEKMDLK<br>FD (SEQ ID NO: 119) |
| c2c2-6 | 2 | Lachno-<br>spiraceae<br>bacterium<br>NK4A 179 | MKISKVREENRGAKLTVNAKTAVVSENRSQEGILYNDPSRY<br>GKSRKNDEDRDRYIESRLKSSGKLYRIFNEDKNKRETDELQ<br>WFLSEIVKKINRRNGLVLSDMLSVDDRAFEKAFEKYAELSYT<br>NRRNKVSGSPAFETCGVDAATAERLKGIISETNFINRIKNNID<br>NKVSEDIIDRIIAKYLKKSLCRERVKRGLKKLLMNAFDLPYS<br>DPDIDVQRDFIDYVLEDFYHVRAKSQVSRSIKNMNMPVQPE<br>GDGKFAITVSKGGTESGNKRSAEKEAFKKFLSDYASLDERV<br>RDDMLRRMRRLVVLYFYGSDDSKLSDVNEKFDVWEDHAA<br>RRVDNREFIKLPLENKLANGKTDKDAERIRKNTVKELYRNQ<br>NIGCYRQAVKAVEEDNNGRYFDDKMLNMFFIHRIEYGVEKI<br>YANLKQVTEFKARTGYLSEKIWKDLINYISIKYIAMGKAVYN<br>YAMDELNASDKKEIELGKISEEYLSGISSFDYELIKAEEMLQR<br>ETAVYVAFAARHLSSQTVELDSENSDFLLLKPKGTMDKNDK<br>NKLASNNILNFLKDKETLRDTILQYFGGHSLWTDFPFDKYLA<br>GGKDDVDFLTDLKDVIYSMRNDSFHYATENHNNGKWNKEL<br>ISAMFEHETERMTVVMKDKFYSNNLPMFYKNDDLKKLLIDL<br>YKDNVERASQVPSFNKVFVRKNFPALVRDKDNLGIELDLKA<br>DADKGENELKFYNALYYMFKEIYYNAFLNDKNVRERFITKA<br>TKVADNYDRNKERNLKDRIKSAGSDEKKKLREQLQNYIAEN<br>DFGQRIKNIVQVNPDYTLAQICQLIMTEYNQQNNGCMQKKS<br>AARKDINKDSYQHYKMLLLVNLRKAFLEFIKENYAFVLKPY<br>KHDLCKDADFVPDFAKYVKPYAGLISRVAGSSELQKWYIVS<br>RFLSPAQANHMLGFLHSYKQYVWDIYRRASETGTEINHSIAE<br>DKIAGVDITDVDAVIDLSVKLCGTISSEISDYFKDDEVYAEYI<br>SSYLDFEYDGGNYKDSLNRFCNSDAVNDQKVALYYDGEHP<br>KLNRNIILSKLYGERRFLEKITDRVSRSDIVEYYKLKKETSQY<br>QTKGIFDSEDEQKNIKKFQEMKNIVEFRDLMDYSEIADELQG<br>QLINWIYLRERDLMNFQLGYHYACLNNDSNKQATYVTLDY<br>QGKKNRKINGAILYQICAMYINGLPYYVDKDSSEWTVSDG<br>KESTGAKIGEFYRYAKSFENTSDCYASGLEIFENISEHDNITEL<br>RNYIEHFRYYSSFDRSFLGIYSEVFDRFFTYDLKYRKNVPTIL<br>YNILLQHFVNVRFEFVSGKKMIGIDKKDRKIAKEKECARITIR<br>EKNGVYSEQFTYKLKNGTVYVDARDKRYLQSIIRLLFYPEK<br>VNMDEMIEVKEKKKPSDNNTGKGYSKRDRQQDRKEYDKY<br>KEKKKKEGNFLSGMGGNINWDEINAQLKN (SEQ ID NO: 120) |
| c2c2-7 | 3 | [Clostridium]<br>aminophilum<br>DSM<br>10710 | MKFSKVDHTRSAVGIQKATDSVHGMLYTDPKKQEVNDLDK<br>RFDQLNVKAKRLYNVFNQSKAEEDDDEKRFGKVVKKLNRE<br>LKDLLFHREVSRYNSIGNAKYNYYGIKSNPEEIVSNLGMVES<br>LKGERDPQKVISKLLLYYLRKGLKPGTDGLRMILEASCGLRK<br>LSGDEKELKVFLQTLDEDFEKKTFKKNLIRSIENQNMAVQPS<br>NEGDPIIGITQGRFNSQKNEEKSAIERMMSMYADLNEDHRED<br>VLRKLRRLNVLYFNVDTEKTEEPTLPGEVDTNPVFEVWHDH<br>EKGKENDRQFATFAKILTEDRETRKKEKLAVKEALNDLKSAI<br>RDHNIMAYRCSIKVTEQDKDGLFFEDQRINRFWIHHIESAVE<br>RILASINPEKLYKLRIGYLGEKVWKDLLNYLSIKYIAVGKAV<br>FHPAMEDLGKTGQDIELGKLSNSVSGGLTSFDYEQIRADETL<br>QRQLSVEVAFAANNLFRAVVGQTGKKIEQSKSEENEEDFLL<br>WKAEKIAESIKKEGEGNTLKSILQFFGGASSWDLNHFCAAYG<br>NESSALGYETKFADDLRKAIYSLRNETFHFTTLNKGSFDWNA<br>KLIGDMFSHEAATGIAVERTRFYSNNLPMFYRESDLKRIMDH<br>LYNTYHPRASQVPSFNSVFVRKNFRLFLSNTLNTNTSFDTEV<br>YQKWESGVYYLFKEIYYNSFLPSGDAHHLFFEGLRRIRKEAD<br>NLPIVGKEAKKRNAVQDFGRRCDELKNLSLSAICQMIMTEY<br>NEQNNGNRKVKSTREDKRKPDIFQHYKMLLLRTLQEAFAIYI<br>RREEFKFIFDLPKTLYVMKPVEEFLPNWKSGMFDSLVERVK<br>QSPDLQRWYVLCKFLNGRLLNQLSGVIRSYIQFAGDIQRRAK<br>ANHNRLYMDNTQRVEYYSNVLEVVDFCIKGTSRFSNVFSDY<br>FRDEDAYADYLDNYLQFKDEKIAEVSSFAALKTFCNEEEVK<br>AGIYMDGENPVMQRNIVMAKLFGPDEVLKNVVPKVTREEIE |

TABLE 3-continued

Sequences of C2c2 Species Herein-Identified (See Table 2, Above)

| | | | |
|---|---|---|---|
| | | | EYYQLEKQIAPYRQNGYCKSEEDQKKLLRFQRIKNRVEFQTI<br>TEFSEIINELLGQLISWSFLRERDLLYFQLGFHYLCLHNDTEK<br>PAEYKEISREDGTVIRNAILHQVAAMYVGGLPVYTLADKKL<br>AAFEKGEADCKLSISKDTAGAGKKIKDFFRYSKYVLIKDRML<br>TDQNQKYTIYLAGLELFENTDEHDNITDVRKYVDHFKYYAT<br>SDENAMSILDLYSEIHDRFFTYDMKYQKNVANMLENILLRH<br>FVLIRPEFFTGSKKVGEGKKITCKARAQIEIAENGMRSEDFTY<br>KLSDGKKNISTCMIAARDQKYLNTVARLLYYPHEAKKSIVD<br>TREKKNNKKTNRGDGTFNKQKGTARKEKDNGPREFNDTGF<br>SNTPFAGFDPFRNS (SEQ ID NO: 121) |
| c2c2-8 | 5 | Carno-<br>bacterium<br>gallinarum<br>DSM 4847 | MRITKVKIKLDNKLYQVTMQKEEKYGTLKLNEESRKSTAEIL<br>RLKKASFNKSFHSKTINSQKENKNATIKKNGDYISQIFEKLVG<br>VDTNKNIRKPKMSLTDLKDLPKKDLALFIKRKFKNDDIVEIK<br>NLDLISLFYNALQKVPGEHFTDESWADFCQEMMPYREYKNK<br>FIERKIILLANSIEQNKGFSINPETFSKRKRVLHQWAIEVQERG<br>DFSILDEKLSKLAEIYNFKKMCKRVQDELNDLEKSMKKGKN<br>PEKEKEAYKKQKNFKIKTIWKDYPYKTHIGLIEKIKENEELN<br>QFNIEIGKYFEHYFPIKKERCTEDEPYYLNSETIATTVNYQLK<br>NALISYLMQIGKYKQFGLENQVLDSKKLQEIGIYEGFQTKFM<br>DACVFATSSLKNIIEPMRSGDILGKREFKEAIATSSFVNYHHF<br>FPYFPFELKGMKDRESELIPFGEQTEAKQMQNIWALRGSVQQ<br>IRNEIFHSPDKNQKFNLPQLDKSNFEFDASENSTGKSQSYIET<br>DYKFLFEAEKNQLEQFFIERIKSSGALEYYPLKSLEKLFAKKE<br>MKFSLGSQVVAFAPSYKKLVKKGHSYQTATEGTANYLGLS<br>YYNRYELKEESFQAQYYLLKLIYQYVFLPNFSQGNSPAFRET<br>VKAILRINKDEARKKMKKNKKFLRKYAFEQVREMEFKETPD<br>QYMSYLQSEMREEKVRKAEKNDKGFEKNITMNFEKLLMQIF<br>VKGFDVFLTTFAGKELLLSSEEKVIKETEISLSKKINEREKTLK<br>ASIQVEHQLVATNSAISYWLFCKLLDSRHLNELRNEMIKFKQ<br>SRIKFNHTQHAELIQNLLPIVELTILSNDYDEKNDSQNVDVSA<br>YFEDKSLYETAPYVQTDDRTRVSFRPILKLEKYHTKSLIEALL<br>KDNPQFRVAATDIQEWMHKREEIGELVEKRKNLHTEWAEG<br>QQTLGAEKREEYRDYCKKIDRFNWKANKVTLTYLSQLHYLI<br>TDLLGRMVGFSALFERDLVYFSRSFSELGGETYHISDYKNLS<br>GVLRLNAEVKPIKIKNIKVIDNEENPYKGNEPEVKPFLDRLH<br>AYLENVIGIKAVHGKIRNQTAHLSVLQLELSMIESMNNLRDL<br>MAYDRKLKNAVTKSMIKILDKHGMILKLKIDENHKNFEIESL<br>IPKEIIHLKDKAIKTNQVSEEYCQLVLALLTTNPGNQLN<br>(SEQ ID NO: 122) |
| c2c2-9 | 6 | Carno-<br>bacterium<br>gallinarum<br>DSM 4847 | MRMTKVKINGSPVSMNRSKLNGHLVWNGTTNTVNILTKKE<br>QSFAASFLNKTLVKADQVKGYKVLAENIFIIFEQLEKSNSEKP<br>SVYLNNIRRLKEAGLKRFFKSKYHEEIKYTSEKNQSVPTKLN<br>LIPLFFNAVDRIQEDKFDEKNWSYFCKEMSPYLDYKKSYLNR<br>KKEILANSIQQNRGFSMPTAEEPNLLSKRKQLFQQWAMKFQ<br>ESPLIQQNNFAVEQFNKEFANKINELAAVYNVDELCTAITEK<br>LMNFDKDKSNKTRNFEIKKLWKQHPHNKDKALIKLFNQEG<br>NEALNQFNIELGKYFEHYFPKTGKKESAESYYLNPQTIIKTVG<br>YQLRNAFVQYLLQVGKLHQYNKGVLDSQTLQEIGMYEGFQ<br>TKFMDACVFASSSLRNIIQATTNEDILTREKFKKELEKNVELK<br>HDLFFKTEIVEERDENPAKKIAMTPNELDDLWAIRGAVQRVR<br>NQIFHQQINKRHEPNQLKVGSFENGDLGNVSYQKTIYQKLFD<br>AEIKDIEIYFAEKIKSSGALEQYSMKDLEKLFSNKELTLSLGG<br>QVVAFAPSYKKLYKQGYFYQNEKTIELEQFTDYDFSNDVFK<br>ANYYLIKLIYHYVFLPQFSQANNKLFKDTVHYVIQQNKELNT<br>TEKDKKNNKKIRKYAFEQVKLMKNESPEKYMQYLQREMQE<br>ERTIKEAKKTNEEKPNYNFEKLLIQIFIKGFDTFLRNFDLNLNP<br>AEELVGTVKEKAEGLRKRKERIAKILNVDEQIKTGDEEIAFW<br>IFAKLLDARHLSELRNEMIKFKQSSVKKGLIKNGDLIEQMQPI<br>LELCILSNDSESMEKESFDKIEVFLEKVELAKNEPYMQEDKL<br>TPVKFRFMKQLEKYQTRNFIENLVIENPEFKVSEKIVLNWHE<br>EKEKIADLVDKRTKLHEEWASKAREIEEYNEKIKKNKSKKL<br>DKPAEFAKFAEYKIICEAIENFNRLDHKVRLTYLKNLHYLMI<br>DLMGRMVGFSVLFERDFVYMGRSYSALKKQSIYLNDYDTF<br>ANIRDWEVNENKHLFGTSSSDLTFQETAEFKNLKKPMENQL<br>KALLGVTNHSFEIRNNIAHLHVLRNDGKGEGVSLLSCMNDL<br>RKLMSYDRKLKNAVTKAIIKILDKHGMILKLINNDHTKPFEI<br>ESLKPKKIIHLEKSNHSFPMDQVSQEYCDLVKKMLVFTN<br>(SEQ ID NO: 123) |
| c2c2-10 | 7 | Paludibacter<br>prop-<br>ionicigenes<br>WB4 | MRVSKVKVKDGGKDKMVLVHRKTTGAQLVYSGQPVSNET<br>SNILPEKKRQSFDLSTLNKTIIKFDTAKKQKLNVDQYKIVEKI<br>FKYPKQELPKQIKAEEILPFLNHKFQEPVKYWKNGKEESFNL<br>TLLIVEAVQAQDKRKLQPYYDWKTWYIQTKSDLLKKSIENN<br>RIDLTENLSKRKKALLAWETEFTASGSIDLTHYHKVYMTDV<br>LCKMLQDVKPLTDDKGKINTNAYHRGLKKALQNHQPAIGT<br>REVPNEANRADNQLSIYHLEVVKYLEHYFPIKTSKRRNTADD |

TABLE 3-continued

Sequences of C2c2 Species Herein-Identified (See Table 2, Above)

|  |  |  | |
|---|---|---|---|
| | | | IAHYLKAQTLKTTIEKQLVNAIRANIIQQGKTNHHELKADTT SNDLIRIKTNEAFVLNLTGTCAFAANNIRNMVDNEQTNDILG KGDFIKSLLKDNTNSQLYSFFFGEGLSTNKAEKETQLWGIRG AVQQIRNNVNHYKKDALKTVFNISNFENPTITDPKQQTNYA DTIYKARFINELEKIPEAFAQQLKTGGAVSYYTIENLKSLLTT FQFSLCRSTIPFAPGFKKVFNGGINYQNAKQDESFYELMLEQ YLRKENFAEESYNARYFMLKLIYNNLFLPGFTTDRKAFADSV GFVQMQNKKQAEKVNPRKKEAYAFEAVRPMTAADSIADY MAYVQSELMQEQNKKEEKVAEETRINFEKFVLQVFIKGFDS FLRAKEFDFVQMPQPQLTATASNQQKADKLNQLEASITADC KLTPQYAKADDATHIAFYVFCKLLDAAHLSNLRNELIKFRES VNEFKFHEILLEBEICLLSADVVPTDYRDLYSSEADCLARLRP FIEQGADITNWSDLFVQSDKHSPVIHANIELSVKYGTTKLLEQ IINKDTQFKTTEANFTAWNTAQKSIEQLIKQREDHHEQWVK AKNADDKEKQERKREKSNFAQKFIEKHGDDYLDICDYINTY NWLDNKMHFVHLNRLHGLTIELLGRMAGFVALFDRDFQFF DEQQIADEFKLHGFVNLHSIDKKLNEVPTKKIKEIYDIRNKIIQ INGNKINESVRANLIQFISSKRNYYNNAFLHVSNDEIKEKQM YDIRNHIAHFNYLTKDAADFSLIDLINELRELLHYDRKLKNA VSKAFIDLFDKHGMILKLKLNADHKLKVESLEPKKIYHLGSS AKDKPEYQYCTNQVMMAYCNMCRSLLEMKK (SEQ ID NO: 124) |
| c2c2-11 | 9 | Listeria weihenstep- hanensis FSL R9- 0317 | MLALLHQEVPSQKLHNLKSLNTESLTKLFKPKFQNMISYPPS KGAEHVQFCLTDIAVPAIRDLDEIKPDWGIFFEKLKPYTDWA ESYIHYKQTTIQKSIEQNKIQSPDSPRKLVLQKYVTAFLNGEP LGLDLVAKKYKLADLAESFKVVDLNEDKSANYKIKACLQQ HQRNILDELKEDPELNQYGIEVKKYIQRYFPIKRAPNRSKHA RADFLKKELIESTVEQQFKNAVYHYVLEQGKMEAYELTDPK TKDLQDIRSGEAFSFKFINACAFASNNLKMILNPECEKDILGK GDFKKNLPNSTTQSDVVKKMIPFFSDEIQNVNFDEAIWAIRG SIQQIRNEVYHCKKHSWKSILKIKGFEFEPNNMKYTDSDMQK LMDKDIAKIPDFIEEKLKSSGIIRFYSHDKLQSIWEMKQGFSL LTTNAPFVPSFKRVYAKGHDYQTSKNRYYDLGLTTFDILEY GEEDFRARYFLTKLVYYQQFMPWFTADNNAFRDAANFVLR LNKNRQQDAKAFINIREVEEGEMPRDYMGYVQGQIAIHEDS TEDTPNHFEKFISQVFIKGFDSHMRSADLKFIKNPRNQGLEQS EIEEMSFDIKVEPSFLKNKDDYIAFWTFCKMLDARHLSELRN EMIKYDGHLTGEQEIIGLALLGVDSRENDWKQFFSSEREYEK IMKGYVGEELYQREPYRQSDGKTPILFRGVEQARKYGTETVI QRLFDASPEFKVSKCNITEWERQKETIEETIERRKELHNEWE KNPKKPQNNAFFKEYKECCDAIDAYNWHKNKTTLVYVNEL HHLLIEILGRYVGYVAIADRDFQCMANQYFKHSGITERVEY WGDNRLKSIKKLDTFLKKEGLFVSEKNARNHIAHLNYLSLK SECTLLYLSERLREIFKYDRKLKNAVSKSLIDILDRHGMSVVF ANLKENKHRLVIKSLEPKKLRHLGEKKIDNGYIETNQVSEEY CGIVKRLLEI (SEQ ID NO: 125) |
| c2c2-12 | 10 | Listeriaceae bacterium FSL M6- 0635 = Listeria newyorkensis FSL M6-0635 | MKITKMRVDGRTIVMERTSKEGQLGYEGIDGNKTTEIIFDKK KESFYKSILNKTVRKPDEKEKNRRKQAINKAINKEITELMLA VLHQEVPSQKLHNLKSLNTESLTKLFKPKFQNMISYPPSKGA EHVQFCLTDIAVPAIRDLDEIKPDWGIFFEKLKPYTDWAESYI HYKQTTIQKSIEQNKIQSPDSPRKLVLQKYVTAFLNGEPLGL DLVAKKYKLADLAESFKLVDLNEDKSANYKIKACLQQHQR NILDELKEDPELNQYGIEVKKYIQRYFPIKRAPNRSKHARADF LKKELIESTVEQQFKNAVYHYVLEQGKMEAYELTDPKTKDL QDIRSGEAFSFKFINACAFASNNLKMILNPECEKDILGKGNFK KNLPNSTTRSDVVKKMIPFFSDELQNVNFDEAIWAIRGSIQQI RNEVYHCKKHSWKSILKIKGFEFEPNNMKYADSDMQKLMD KDIAKIPEFIEEKLKSSGVVRFYRHDELQSIWEMKQGFSLLTT NAPFVPSFKRVYAKGHDYQTSKNRYYNLDLTTFDILEYGEE DFRARYFLTKLVYYQQFMPWFTADNNAFRDAANFVLRLNK NRQQDAKAFINIREVEEGEMPRDYMGYVQGQIAIHEDSIEDT PNHFEKFISQVFIKGFDRHMRSANLKFIKNPRNQGLEQSEIEE MSFDIKVEPSFLKNKDDYIAFWIFCKMLDARHLSELRNEMIK YDGHLTGEQEIIGLALLGVDSRENDWKQFFSSEREYEKIMKG YVVEELYQREPYRQSDGKTPILFRGVEQARKYGTETVIQRLF DANPEFKVSKCNLAEWERQKETIEETIKRRKELHNEWAKNP KKPQNNAFFKEYKECCDAIDAYNWHKNKTTLAYVNELHHL LIEILGRYVGYVAIADRDFQCMANQYFKHSGITERVEYWGD NRLKSIKKLDTFLKKEGLFVSEKNARNHIAHLNYLSLKSECT LLYLSERLREIFKYDRKLKNAVSKSLIDILDRHGMSVVFANL KENKHRLVIKSLEPKKLRHLGGKKIDGGYIETNQVSEEYCGI VKRLLEM (SEQ ID NO: 126) |
| c2c2-13 | 12 | Leptotrichia wadei F0279 | MKVTKVDGISHKKYIEEGKLVKSTSEENRTSERLSELLSIRLD IYIKNPDNASEEENRIRRENLKKFFSNKVLHLKDSVLYLKNR KEKNAVQDKNYSEEDISEYDLKNKNSFSVLKKILLNEDVNSE ELEIFRKDVEAKLNKINSLKYSFEENKANYQKINENNVEKVG |

TABLE 3-continued

Sequences of C2c2 Species Herein-Identified (See Table 2, Above)

|  |  |  |  |
|---|---|---|---|
|  |  |  | GKSKRNIIYDYYRESAKRNDYINNVQEAFDKLYKKEDIEKLF<br>FLIENSKKHEKYKIREYYHKIIGRKNDKENFAKIIYEEIQNVN<br>NIKELIEKIPDMSELKKSQVFYKYYLDKEELNDKNIKYAFCH<br>FVEIEMSQLLKNYVYKRLSNISNDKIKRIFEYQNLKKLIENKL<br>LNKLDTYVRNCGKYNYYLQVGEIATSDFIARNRQNEAFLRNI<br>IGVSSVAYFSLRNILETENENDITGRMRGKTVKNNKGEEKYV<br>SGEVDKIYNENKQNEVKENLKMFYSYDFNMDNKNEIEDFFA<br>NIDEAISSIRHGIVHFNLELEGKDIFAFKNIAPSEISKKMFQNEI<br>NEKKLKLKIFKQLNSANVFNYYEKDVIIKYLKNTKFNFVNK<br>NIPFVPSFTKLYNKIEDLRNTLKFFWSVPKDKEEKDAQIYLLK<br>NIYYGEFLNKFVKNSKVFFKITNEVIKINKQRNQKTGHYKYQ<br>KFENIEKTVPVEYLAIIQSREMINNQDKEEKNTYIDFIQQIFLK<br>GFIDYLNKNNLKYIESNNNNDNNDIFSKIKIKKDNKEKYDKIL<br>KNYEKHNRNKEIPHEINEFVREIKLGKILKYTENLNMFYLILK<br>LLNHKELTNLKGSLEKYQSANKEETFSDELELINLLNLDNNR<br>VTEDFELEANEIGKFLDFNENKIKDRKELKKFDTNKIYFDGE<br>NIIKHRAFYNIKKYGMLNLLEKIADKAKYKISLKELKEYSNK<br>KNEIEKNYTMQQNLHRKYARPKKDEKFNDEDYKEYEKAIG<br>NIQKYTHLKNKVEFNELNLLQGLLLKILHRLVGYTSIWERDL<br>RFRLKGEFPENHYIEEIFNFDNSKNVKYKSGQIVEKYINFYKE<br>LYKDNVEKRSIYSDKKVKKLKQEKKDLYIRNYIAHFNYIPHA<br>EISLLEVLENLRKLLSYDRKLKNAIMKSIVDILKEYGFVATFK<br>IGADKKIEIQTLESEKIVHLKNLKKKKLMTDRNSEELCELVK<br>VMFEYKALE (SEQ ID NO: 127) |
| c2c2-14 | 15 | Rhodobacter<br>capsulatus<br>SB 1003 | MQIGKVQGRTISEFGDPAGGLKRKISTDGKNRKELPAHLSSD<br>PKALIGQWISGIDKIYRKPDSRKSDGKAIHSPTPSKMQFDARD<br>DLGEAFWKLVSEAGLAQDSDYDQFKRRLHPYGDKFQPADS<br>GAKLKFEADPPEPQAFHGRWYGAMSKRGNDAKELAAALYE<br>HLHVDEKRIDGQPKRNPKTDKFAPGLVVARALGIESSVLPRG<br>MARLARNWGEEEIQTYFVVDVAASVKEVAKAAVSAAQAFD<br>PPRQVSGRSLSPKVGFALAEHLERVTGSKRCSFDPAAGPSVL<br>ALHDEVKKTYKRLCARGKNAARAFPADKTELLALMRHTHE<br>NRVRNQMVRMGRVSEYRGQQAGDLAQSHYWTSAGQTEIK<br>ESEIFVRLWVGAFALAGRSMKAWIDPMGKIVNTEKNDRDLT<br>AAVNIRQVISNKEMVAEAMARRGIYFGETPELDRLGAEGNE<br>GFVFALLRYLRGCRNQTFHLGARAGFLKEIRKELEKTRWGK<br>AKEAEHVVLTDKTVAAIRAIIDNDAKALGARLLADLSGAFV<br>AHYASKEHFSTLYSEIVKAVKDAPEVSSGLPRLKLLLKRADG<br>VRGYVHGLRDTRKHAFATKLPPPPAPRELDDPATKARYIALL<br>RLYDGPFRAYASGITGTALAGPAARAKEAATALAQSVNVTK<br>AYSDVMEGRTSRLRPPNDGETLREYLSALTGETATEFRVQIG<br>YESDSENARKQAEFIENYRRDMLAFMFEDYIRAKGFDWILKI<br>EPGATAMTRAPVLPEPIDTRGQYEHWQAALYLVMHFVPASD<br>VSNLLHQLRKWEALQGKYELVQDGDATDQADARREALDL<br>VKRFRDVLVLFLKTGEARFEGRAAPFDLKPFRALFANPATFD<br>RLFMATPTTARPAEDDPEGDGASEPELRVARTLRGLRQIARY<br>NHMAVLSDLFAKHKVRDEEVARLAEIEDETQEKSQIVAAQE<br>LRTDLHDKVMKCHPKTISPEERQSYAAAIKTIEEHRFLVGRV<br>YLGDHLRLHRLMMDVIGRLIDYAGAYERDTGTFLINASKQL<br>GAGADWAVTIAGAANTDARTQTRKDLAHFNVLDRADGTPD<br>LTALVNRAREMMAYDRKRKNAVPRSILDMLARLGLTLKWQ<br>MKDHLLQDATITQAAIKHLDKVRLTVGGPAAVTEARFSQDY<br>LQMVAAVFNGSVQNPKPRRRDDGDAWHKPPKPATAQSQPD<br>QKPPNKAPSAGSRLPPPQVGEVYEGVVVKVIDTGSLGFLAVE<br>GVAGNIGLHISRLRRIREDAIIVGRRYRFRVEIYVPPKSNTSKL<br>NAADLVRID (SEQ ID NO: 128) |
| c2c2-15 | 16 | Rhodobacter<br>capsulatus<br>R121 | MQIGKVQGRTISEFGDPAGGLKRKISTDGKNRKELPAHLSSD<br>PKALIGQWISGIDKIYRKPDSRKSDGKAIHSPTPSKMQFDARD<br>DLGEAFWKLVSEAGLAQDSDYDQFKRRLHPYGDKFQPADS<br>GAKLKFEADPPEPQAFHGRWYGAMSKRGNDAKELAAALYE<br>HLHVDEKRIDGQPKRNPKTDKFAPGLVVARALGIESSVLPRG<br>MARLARNWGEEEIQTYFVVDVAASVKEVAKAAVSAAQAFD<br>PPRQVSGRSLSPKVGFALAEHLERVTGSKRCSFDPAAGPSVL<br>ALHDEVKKTYKRLCARGKNAARAFPADKTELLALMRHTHE<br>NRVRNQMVRMGRVSEYRGQQAGDLAQSHYWTSAGQTEIK<br>ESEIFVRLWVGAFALAGRSMKAWIDPMGKIVNTEKNDRDLT<br>AAVNIRQVISNKEMVAEAMARRGIYFGETPELDRLGAEGNE<br>GFVFALLRYLRGCRNQTFHLGARAGFLKEIRKELEKTRWGK<br>AKEAEHVVLTDKTVAAIRAIIDNDAKALGARLLADLSGAFV<br>AHYASKEHFSTLYSEIVKAVKDAPEVSSGLPRLKLLLKRADG<br>VRGYVHGLRDTRKHAFATKLPPPPAPRELDDPATKARYIALL<br>RLYDGPFRAYASGITGTALAGPAARAKEAATALAQSVNVTK<br>AYSDVMEGRSSRLRPPNDGETLREYLSALTGETATEFRVQIG<br>YESDSENARKQAEFIENYRRDMLAFMFEDYIRAKGFDWILKI<br>EPGATAMTRAPVLPEPIDTRGQYEHWQAALYLVMHFVPASD<br>VSNLLHQLRKWEALQGKYELVQDGDATDQADARREALDL |

TABLE 3-continued

Sequences of C2c2 Species Herein-Identified (See Table 2, Above)

| | | | |
|---|---|---|---|
| | | | VKRFRDVLVLFLKTGEARFEGRAAPFDLKPFRALFANPATFD RLFMATPTTARPAEDDPEGDGASEPELRVARTLRGLRQIARY NHMAVLSDLFAKHKVRDEEVARLAEIEDETQEKSQIVAAQE LRTDLHDKVMKCHPKTISPEERQSYAAAIKTIEEHRFLVGRV YLGDHLRLHRLMMDVIGRLIDYAGAYERDTGTFLINASKQL GAGADWAVTIAGAANTDARTQTRKDLAHFNVLDRADGTPD LTALVNRAREMMAYDRKRKNAVPRSILDMLARLGLTLKWQ MKDHLLQDATITQAAIKHLDKVRLTVGGPAAVTEARFSQDY LQMVAAVFNGSVQNPKPRRRDDGDAWHKPPKPATAQSQPD QKPPNKAPSAGSRLPPPQVGEVYEGVVVKVIDTGSLGFLAVE GVAGNIGLHISRLRRIREDAIIVGRRYRFRVEIYVPPKSNTSKL NAADLVRID (SEQ ID NO: 129) |
| c2c2-16 | 17 | Rhodobacter capsulatus DE442 | MQIGKVQGRTISEFGDPAGGLKRKISTDGKNRKELPAHLSSD PKALIGQWISGIDKIYRKPDSRKSDGKAIHSPTPSKMQFDARD DLGEAFWKLVSEAGLAQDSDYDQFKRRLHPYGDKFQPADS GAKLKFEADPPEPQAFHGRWYGAMSKRGNDAKELAAALYE HLHVDEKRIDGQPKRNPKTDKFAPGLVVARALGIESSVLPRG MARLARNWGEEEIQTYFVVDVAASVKEVAKAAVSAAQAFD PPRQVSGRSLSPKVGFALAEHLERVTGSKRCSFDPAAGPSVL ALHDEVKKTYKRLCARGKNAARAFPADKTELLALMRHTHE NRVRNQMVRMGRVSEYRGQQAGDLAQSHYWTSAGQTEIK ESEIFVRLWVGAFALAGRSMKAWIDPMGKIVNTEKNDRDLT AAVNIRQVISNKEMVAEAMARRGIYFGETPELDRLGAEGNE GFVPALLRYLRGCRNQTPHLGARAGFLKEIRKELEKTRWGK AKEAEHVVLTDKTVAAIRAIIDNDAKALGARLLADLSGAFV AHYASKEHFSTLYSEIVKAVKDAPEVSSGLPRLKLLLKRADG VRGYVHGLRDTRKHAFATKLPPPPAPRELDDPATKARYIALL RLYDGPFRAYASGITGTALAGPAARAKEAATALAQSVNVTK AYSDVMEGRSSRLRPPNDGETLREYLSALTGETATEFRVQIG YESDSENARKQAEFIENYRRDMLAFMFEDYIRAKGFDWILKI EPGATAMTRAPVLPEPIDTRGQYEHWQAALYLVMHFVPASD VSNLLHQLRKWEALQGKYELVQDGDATDQADARREALDL VKRFRDVLVLFLKTGEARFEGRAAPFDLKPFRALFANPATFD RLFMATPTTARPAEDDPEGDGASEPELRVARTLRGLRQIARY NHMAVLSDLFAKHKVRDEEVARLAEIEDETQEKSQIVAAQE LRTDLHDKVMKCHPKTISPEERQSYAAAIKTIEEHRFLVGRV YLGDHLRLHRLMMDVIGRLIDYAGAYERDTGTFLINASKQL GAGADWAVTIAGAANTDARTQTRKDLAHFNVLDRADGTPD LTALVNRAREMMAYDRKRKNAVPRSILDMLARLGLTLKWQ MKDHLLQDATITQAAIKHLDKVRLTVGGPAAVTEARFSQDY LQMVAAVFNGSVQNPKPRRRDDGDAWHKPPKPATAQSQPD QKPPNKAPSAGSRLPPPQVGEVYEGVVVKVIDTGSLGFLAVE GVAGNIGLHISRLRRIREDAIIVGRRYRFRVEIYVPPKSNTSKL NAADLVRID (SEQ ID NO: 130) |
| c2-2 | | | MGNLFGHKRWYEVRDKKDFKIKRKVKVRNYDGNKYILNI NENNNKEKIDNNKFIRKYINYKKNDNILKEFTRKFHAGNILF KLKGKEGIIRIENNDDFLETEEVVLYIEAYGKSEKLKALGITK KKIIDEAIRQGITKDDKKIEIKRQENEEEIEIDIRDEYTNKTLND CSIILRIIENDELETKKSIYEIFKNINMSLYKIIEKIIENETEKVFE NRYYEEHLREKLLKDDKIDVILTNFMEIREKIKSNLEILGFVK FYLNVGGDKKKSKNKKMLVEKILNINVDLTVEDIADFVIKEL EFWNITKRIEKVKKVNNEFLEKRRNRTYIKSYVLLDKHEKFK IERENKKDKIVKFFVENIKNNSIKEKIEKILAEFKIDELIKKLEK ELKKGNCDTEIFGIFKKHYKVNFDSKKFSKKSDEEKELYKIIY RYLKGRIEKILVNEQKVRLKKMEKIEIEKILNESILSEKILKRV KQYTLEHIMYLGKLRHNDIDMTTVNTDDFSRLHAKEELDLE LITFFASTNMELNKIFSRENINNDENIDFFGGDREKNYVLDKK ILNSKIKIIRDLDFIDNKNNITNNFIRKFTKIGTNERNRILHAISK ERDLQGTQDDYNKVINIIQNLKISDEEVSKALNLDVVFKDKK NIITKINDIKISEENNNDIKYLPSFSKVLPEILNLYRNNPKNEPF DTIETEKIVLNALIYVNKELYKKLILEDDLEENESKNIFLQELK KTLGNIDEIDENIIENYYKNAQISASKGNNKAIKKYQKKVIEC YIGYLRKNYEELFDFSDFKMNIQEIKKQIKDINDNKTYERITV KTSDKTIVINDDFEYIISIFALLNSNAVINKIRNRFFATSVWLN TSEYQNIIDILDEIMQLNTLRNECITENWNLNLEEFIQKMKEIE KDFDDFKIQTKKEIFNNYYEDIKNNILTEFKDDINGCDVLEKK LEKIVIFDDETKFEIDKKSNILQDEQRKLSNINKKDLKKKVDQ YIKDKDQEIKSKILCRIIFNSDFLKKYKKEIDNLIEDMESENEN KFQEIYYPKERKNELYIYKKNLFLNIGNPNFDKIYGLISNDIK MADAKFLFNIDGKNIRKNKISEIDAILKNLNDKLNGYSKEYK EKYIKKLKENDDFFAKNIQNKNYKSFEKDYNRVSEYKKIRD LVEFNYLNKIESYLIDINWKLAIQMARFERDMHYIVNGLREL GIIKLSGYNTGISRAYPKRNGSDGFYTTTAYYKFFDEESYKKF |

TABLE 3-continued

Sequences of C2c2 Species Herein-Identified (See Table 2, Above)

| | | |
|---|---|---|
| | | EKICYGFGIDLSENSEINKPENESIRNYISHFYIVRNPFADYSIA<br>EQIDRVSNLLSYSTRYNNSTYASVFEVFKKDVNLDYDELKK<br>KFKLIGNNDILERLMKPKKVSVLELESYNSDYIKNLIIELLTKI<br>ENTNDTL (SEQ ID NO: 131) |
| c2-3 | L wadei<br>(Lw2) | MKVTKVDGISHKKYIEEGKLVKSTSEENRTSERLSELLSIRLD<br>IYIKNPDNASEEENRIRRENLKKFFSNKVLHLKDSVLYLKNR<br>KEKNAVQDKNYSEEDISEYDLKNKNSFSVLKKILLNEDVNSE<br>ELEIFRKDVEAKLNKINSLKYSFEENKANYQKINENNVEKVG<br>GKSKRNIIYDYYRESAKRNDYINNVQEAFDKLYKKEDIEKLF<br>FLIENSKKHEKYKIREYYHKIIGRKNDKENFAKIIYEEIQNVN<br>NIKELIEKIPDMSELKKSQVFYKYYLDKEELNDKNIKYAFCH<br>FVEIEMSQLLKNYVYKRLSNISNDKIKRIFEYQNLKKLIENKL<br>LNKLDTYVRNCGKYNYYLQVGEIATSDFIARNRQNEAFLRNI<br>IGVSSVAYFSLRNILETENENDITGRMRGKTVKNNKGEEKYV<br>SGEVDKIYNENKQNEVKENLKMFYSYDFNMDNKNEIEDFFA<br>NIDEAISSIRHGIVHFNLELEGKDIFAFKNIAPSEISKKMFQNEI<br>NEKKLKLKIFKQLNSANVFNYYEKDVIIKYLKNTKFNFVNK<br>NIPPFVPSFTKLYNKIEDLRNTLKFFWSVPKDKEEKDAQIYLLK<br>NIYYGEFLNKFVKNSKVFFKITNEVIKINKQRNQKTGHYKYQ<br>KFENIEKTVPVEYLAIIQSREMINNQDEEKNTYIDFIQQIFLK<br>GFIDYLNKNNLKYIESNNNNDNNDIFSKIKIKKDNKEKYDKIL<br>KNYEKHNRNKEIPHEINEFVREIKLGKILKYTENLNMFYLILK<br>LLNHKELTNLKGSLEKYQSANKEETFSDELELINLLNLDNNR<br>VTEDFELEANEIGKFLDFNENKIKDRKELKKFDTNKIYPDGE<br>NIIKHRAFYNIKKYGMLNLLEKIADKAKYKISLKELKEYSNK<br>KNEIEKNYTMQQNLHRKYARPKKDEKFNDEDYKEYEKAIG<br>NIQKYTHLKNKVEFNELNLLQGLLLKILHRLVGYTSIWERDL<br>RFRLKGEFPENHYIEEIFNFDNSKNVKYKSGQIVEKYINFYKE<br>LYKDNVEKRSIYSDKKVKKLKQEKKDLYIRNYIAHFNYIPHA<br>EISLLEVLENLRKLLSYDRKLKNAIMKSIVDILKEYGFVATFK<br>IGADKKIEIQTLESEKIVHLKNLKKKKLMTDRNSEELCELVK<br>VMFEYKALEKRPAATKKAGQAKKKKGSYPYDVPDYAYPY<br>DVPDYAYPYDVPDYA* (SEQ ID NO: 132) |
| c2-4 | Listeria<br>seeligeri | MWISIKTLIFIFILGVLFFCDYMYNRREKKIIEVKTMRITKVEV<br>DRKKVLISRDKNGGKLVYENEMQDNTEQIMHHKKSSFYKS<br>VVNKTICRPEQKQMKKLVHGLLQENSQEKIKVSDVTKLNIS<br>NFLNHRFKKSLYYFPENSPDKSEEYRIEINLSQLLEDSLKKQQ<br>GTFICWESFSKDMELYINWAENYISSKTKLIKKSIRNNRIQST<br>ESRSGQLMDRYMKDILNKNKPFDIQSVSEKYQLEKLTSALK<br>ATFKEAKKNDKEINYKLKSTLQNHERQIIEELKENSELNQFNI<br>EIRKHLETYFPIKKTNRKVGDIRNLEIGEIQKIVNHRLKNKIVQ<br>RILQEGKLASYEIESTVNSNSLQKIKIEEAFALKFINACLFASN<br>NLRNMVYPVCKKDILMIGEFKNSFKEIKHKKFIRQWSQFFSQ<br>EITVDDIELASWGLRGAIAPIRNEIIHLKKHSWKKFFNNPTFK<br>VKKSKIINGKTKDVTSEFLYKETLFKDYFYSELDSVPELIINK<br>MESSKILDYYSSDQLNQVFTIPNFELSLLTSAVPFAPSFKRVY<br>LKGFDYQNQDEAQPDYNLKLNIYNEKAFNSEAFQAQYSLFK<br>MVYYQVFLPQFTTNNDLFKSSVDFILTLNKERKGYAKAFQDI<br>RKMNKDEKPSEYMSYIQSQLMLYQKKQEEKEKINHFEKFIN<br>QVFIKGFNSFIEKNRLTYICHPTKNTVPENDNIEIPFHTDMDDS<br>NIAFWLMCKLLDAKQLSELRNEMIKFSCSLQSTEEISTFTKAR<br>EVIGLALLNGEKGCNDWKELFDDKEAWKKNMSLYVSEELL<br>QSLPYTQEDGQTPVINRSIDLVKKYGTETILEKLFSSSDDYKV<br>SAKDIAKLHEYDVTEKIAQQESLHKQWIEKPGLARDSAWTK<br>KYQNVINDISNYQWAKTKVELTQVRHLHQLTIDLLSRLAGY<br>MSIADRDFQFSSNYILERENSEYRVTSWILLSENKNKNKYND<br>YELYNLKNASIKVSSKNDPQLKVDLKQLRLTLEYLELFDNRL<br>KEKRNNISHFNYLNGQLGNSILELFDDARDVLSYDRKLKNA<br>VSKSLKEILSSHGMEVTFKPLYQTNHHLKIDKLQPKKIREILG<br>EKSTVSSNQVSNEYCQLVRTLLTMK (SEQ ID NO: 133) |
| C2-17 | Leptotrichia<br>buccalis<br>C-1013-b | MKVTKVGGISHKKYTSEGRLVKSESEENRTDERLSALLNMR<br>LDMYIKNPSSTETKENQKRIGKLKKFFSNKMVYLKDNTLSL<br>KNGGKKENIDREYSETDILESDVRDKKNFAVLKKIYLNENVS<br>EELEVFRNDIKKKLNKINSLKYSFEKNKANYQKINENNIEKV<br>EGKSKRNIIYDYYRESAKRDAYVSNVKEAFDKLYKEEDIAK<br>LVLEIENLTKLEKYKIREFYHEIIGRKNDKENFAKIIYEEIQNV<br>NNMKELIEKVPDMSELKKSQVFYKYYLDKEELNDKNIKYAF<br>CHFVEIEMSQLLKNYVYKRLSNISNDKIKRIFEYQNLKKLIEN<br>KLLNKLDTYVRNCGKYNYYLQDGEIATSDFIARNRQNEAFL<br>RNIIGVSSVAYFSLRNILETENENDITGRMRGKTVKNNKGEE<br>KYVSGEVDKIYNENKKNEVKENLKMFYSYDFNMDNKNEIE<br>DFFANIDEAISSIRHGIVHFNLELEGKDIFAFKNIAPSEISKKMF<br>QNEINEKKLKLKIFRQLNSANVFRYLEKYKILNYLKRTRFEF<br>VNKNIPPFVPSFTKLYSRIDDLKNSLGIYWKTPKTNDDNKTKEI<br>IDAQIYLLKNIYYGEFLNYFMSNNGNFFEISKEIIELNKNDKR |

TABLE 3-continued

Sequences of C2c2 Species Herein-Identified (See Table 2, Above)

| | | |
|---|---|---|
| | | NLKTGFYKLQKFEDIQEKIPKEYLANIQSLYMINAGNQDEEE KDTYIDFIQKIFLKGFMTYLANNGRLSLIYIGSDEETNTSLAE KKQEFDKFLKKYEQNNNIKIPYEINEFLREIKLGNILKYTERL NMFYLILKLLNHKELTNLKGSLEKYQSANKEEAFSDQLELIN LLNLDNNRVTEDFELEADEIGKFLDFNGNKVKDNKELKKFD TNKIYFDGENIIKHRAFYNIKKYGMLNLLEKIADKAGYKISIE ELKKYSNKKNEIEKNHKMQENLHRKYARPRKDEKFTDEDY ESYKQAIENIEEYTHLKNKVEFNELNLLQGLLLRILHRLVGY TSIWERDLRFRLKGEFPENQYIEEIFNFENKKNVKYKGGQIVE KYIKFYKELHQNDEVKINKYSSANIKVLKQEKKDLYIRNYIA HFNYIPHAEISLLEVLENLRKLLSYDRKLKNAVMKSVVDILK EYGFVATFKIGADKKIGIQTLESEKIVHLKNLKKKKLMTDRN SEELCKLVKIMFEYKMEEKKSEN (SEQ ID NO: 134) |
| C2-18 | Herbinix hemicellulo silytica | MKLTRRRISGNSVDQKITAAFYRDMSQGLLYYDSEDNDCTD KVIESMDFERSWRGRILKNGEDDKNPFYMFVKGLVGSNDKI VCEPIDVDSDPDNLDILINKNLTGFGRNLKAPDSNDTLENLIR KIQAGIPEEEVLPELKKIKEMIQKDIVNREQLLKSIKNNRIPF SLEGSKLVPSTKKMKWLFKLIDVPNKTFNEKMLEKYWEIYD YDKLKANITNRLDKTDKKARSISRAVSEELREYHKNLRTNY NRFVSGDRPAAGLDNGGSAKYNPDKEEFLLFLKEVEQYFKK YFPVKSKHSNKSKDKSLVDKYKNYCSYKVVKKEVNRSIINQ LVAGLIQQGKLLYYFYYNDTWQEDFLNSYGLSYIQVEEAFK KSVMTSLSWGINRLTSFFIDDSNTVKFDDITTKKAKEAIESNY FNKLRTCSRMQDHFKEKLAFFYPVYVKDKKDRPDDDIENLI VLVKNAIESVSYLRNRTFHFKESSLLELLKELDDKNSGQNKI DYSVAAEFIKRDIENLYDVFREQIRSLGIAEYYKADMISDCFK TCGLEFALYSPKNSLMPAFKNVYKRGANLNKAYIRDKGPKE TGDQGQNSYKALEEYRELTWYIEVKNNDQSYNAYKNLLQLI YYHAFLPEVRENEALITDFINRTKEWNRKETEERLNTKNNKK HKNFDENDDITVNTYRYESIPDYQGESLDDYLKVLQRKQMA RAKEVNEKEEGNNNYIQFIRDVVVWAFGAYLENKLKNYKN ELQPPLSKENIGLNDTLKELFPEEKVKSPFNIKCRFSISTFIDNK GKSTDNTSAEAVKTDGKEDEKDKKNIKRKDLLCFYLFLRLL DENEICKLQHQFIKYRCSLKERRFPGNRTKLEKETELLAELEE LMELVRFTMPSIPEISAKAESGYDTMIKKYFKDFIEKKVFKNP KTSNLYYHSDSKTPVTRKYMALLMRSAPLHLYKDIFKGYYL ITKKECLEYIKLSNIIKDYQNSLNELHEQLERIKLKSEKQNGK DSLYLDKKDFYKVKEYVENLEQVARYKHLQHKINFESLYRI FRIHVDIAARMVGYTQDWERDMHFLFKALVYNGVLEERRF EAIFNNNDDNNDGRIVKKIQNNLNNKNRELVSMLCWNKKL NKNEFGAIIWKRNPIAHLNHFTQTEQNSKSSLESLINSLRILLA YDRKRQNAVTKTINDLLLNDYHIRIKWEGRVDEGQIYFNIKE KEDIENEPIIHLKHLHKKDCYIYKNSYMFDKQKEWICNGIKE EVYDKSILKCIGNLFKFDYEDKNKSSANPKHT (SEQ ID NO: 135) |
| C2-1 9 | [Eubacterium] rectale | MLRRDKEVKKLYNVFNQIQVGTKPKKWNNDEKLSPEENER RAQQKNIKMKNYKWREACSKYVESSQRIINDVIFYSYRKAK NKLRYMRKNEDILKKMQEAEKLSKFSGGKLEDFVAYTLRKS LVVSKYDTQEFDSLAAMVVFLECIGKNNISDHEREIVCKLLE LIRKDFSKLDPNVKGSQGANIVRSVRNQNMIVQPQGDRFLFP QVYAKENETVTNKNVEKEGLNEFLLNYANLDDEKRAESLR KLRRILDVYFSAPNHYEKDMDITLSDNIEKEKFNVWEKHEC GKKETGLFVDIPDVLMEAEAENIKLDAVVEKRERKVLNDRV RKQNIICYRYTRAVVEKYNSNEPLFFENNAINQYWIHHIENA VERILKNCKAGKLFKLRKGYLAEKVWKDAINLISIKYIALGK AVYNFALDDIWKDKKNKELGIVDERIRNGITSFDYEMIKAHE NLQRELAVDIAFSVNNLARAVCDMSNLGNKESDFLLWKRN DIADKLKNKDDMASVSAVLQFFGGKSSWDINIFKDAYKGKK KYNYEVRFIDDLRKAIYCARNENFHFKTALVNDEKWNTELF GKIFERETEFCLNVEKDRFYSNNLYMFYQVSELRNMLDHLY SRSVSRAAQVPSYNSVIVRTAFPEYITNVLGYQKPSYDADTL GKWYSACYYLLKEIYYNSFLQSDRALQLFEKSVKTLSWDDK KQQRAVDNFKDHFSDIKSACTSLAQVCQIYMTEYNQQNNQI KKVRSSNDSIFDQPVYQHYKVLLKKAIANAFADYLKNNKDL FGFIGKPFKANEIREIDKEQFLPDWTSRKYEALCIEVSGSQEL QKWYIVGKFLNARSLNLMVGSMRSYIQYVTDIKRRAASIGN ELHVSVHDVEKVEKWVQVIEVCSLLASRTSNQFEDYFNDKD DYARYLKSYVDFSNVDMPSEYSALVDFSNEEQSDLYVDPKN PKVNRNIVHSKLFAADHILRDIVEPVSKDNIEEFYSQKAEIAY CKIKGKEITAEEQKAVLKYQKLKNRVELRDIVEYGEIINELLG QLINWSFMRERDLLYFQLGFHYDCLRNDSKKPEGYKNIKVD ENSIKDAILYQIIGMYVNGVTVYAPEKDGDKLKEQCVKGGV GVKVSAFHRYSKYLGLNEKTLYNAGLEIFEVVAEHEDIINLR NGIDHFKYYLGDYRSMLSIYSEVFDRFFTYDIKYQKNVLNLL QNILLRHNVIVEPILESGFKTIGEQTKPGAKLSIRSIKSDTFQY KVKGGTLITDAKDERYLETIRKILYYAENEEDNLKKSVVVTN |

TABLE 3-continued

Sequences of C2c2 Species Herein-Identified (See Table 2, Above)

|  |  |  |
|---|---|---|
|  |  | ADKYEKNKESDDQNKQKEKKNKDNKGKKNEETKSDAEKN<br>NNERLSYNPFANLNFKLSN (SEQ ID NO: 136) |
| C2-20 | Eubacteriaceae<br>bacterium<br>CHKCI004 | MKISKESHKRTAVAVMEDRVGGVVYVPGGSGIDLSNNLKK<br>RSMDTKSLYNVFNQIQAGTAPSEYEWKDYLSEAENKKREAQ<br>KMIQKANYELRRECEDYAKKANLAVSRIIFSKKPKKIFSDDDI<br>ISHMKKQRLSKFKGRMEDFVLIALRKSLVVSTYNQEVFDSR<br>KAATVFLKNIGKKNISADDERQIKQLMALIREDYDKWNPDK<br>DSSDKKESSGTKVIRSIEHQNMVIQPEKNKLSLSKISNVGKKT<br>KTKQKEKAGLDAFLKEYAQIDENSRMEYLKKLRRLLDTYFA<br>APSSYIKGAAVSLPENINFSSELNVWERHEAAKKVNINFVEIP<br>ESLLNAEQNNNKINKVEQEHSLEQLRTDIRRRNITCYHFANA<br>LAADERYHTLFFENMAMNQFWIFIRMENAVERILKKCNVGT<br>LFKLRIGYLSEKVWKDMLNLLSIKYIALGKAVYHFALDDIW<br>KADIWKDASDKNSGKINDLTLKGISSFDYEMVKAQEDLQRE<br>MAVGVAFSTNNLARVTCKMDDLSDAESDFLLWNKEAIRRH<br>VKYTEKGEILSAILQFFGGRSLWDESLFEKAYSDSNYELKFL<br>DDLKRAIYAARNETFHFKTAAIDGGSWNTRLFGSLFEKEAGL<br>CLNVEKNKFYSNNLVLFYKQEDLRVFLDKLYGKECSRAAQI<br>PSYNTILPRKSFSDFMKQLLGLKEPVYGSAILDQWYSACYYL<br>FKEVYYNLFLQDSSAKALFEKAVKALKGADKKQEKAVESFR<br>KRYWEISKNASLAEICQSYITEYNQQNNKERKVRSANDGMF<br>NEPIYQHYKMLLKEALKMAFASYIKNDKELKFVYKPTEKLF<br>EVSQDNFLPNWNSEKYNTLISEVKNSPDLQKWYIVGKFMNA<br>RMLNLLLGSMRSYLQYVSDIQKRAAGLGENQLHLSAENVG<br>QVKKWIQVLEVCLLLSVRISDKFTDYFKDEEEYASYLKEYV<br>DFEDSAMPSDYSALLAFSNEGKIDLYVDASNPKVNRNIIQAK<br>LYAPDMVLKKVVKKISQDECKEFNEKKEQIMQFKNKGDEVS<br>WEEQQKILEYQKLKNRVELRDLSEYGELINELLGQLINWSYL<br>RERDLLYFQLGFHYSCLMNESKKPDAYKTIRRGTVSIENAVL<br>YQIIAMYINGFPVYAPEKGELKPQCKTGSAGQKIRAFCQWAS<br>MVEKKKYELYNAGLELFEVVKEHDNIIDLRNKIDHFKYYQG<br>NDSILALYGEIFDRFFTYDMKYRNNVLNHLQNILLRHNVIIKP<br>IISKDKKEVGRGKMKDRAAFLLEEVSSDRFTYKVKEGERKID<br>AKNRLYLETVRDILYFPNRAVNDKGEDVIICSKKAQDLNEK<br>KADRDKNHDKSKDTNQKKEGKNQEEKSENKEPYSDRMTW<br>KPPAGIKLE (SEQ ID NO: 137) |
| C2-210 | Blautia sp.<br>Marseille-<br>P2398 | MKISKVDHVKSGIDQKLSSQRGMLYKQPQKKYEGKQLEEH<br>VRNLSRKAKALYQVFPVSGNSKMEKELQIINSFIKNILLRLDS<br>GKTSEEIVGYINTYSVASQISGDHIQELVDQHLKESLRKYTCV<br>GDKRIYVPDIIVALLKSKFNSETLQYDNSELKILIDFIREDYLK<br>EKQIKQIVHSIENNSTPLRIAEINGQKRLIPANVDNPKKSYIFE<br>FLKEYAQSDPKGQESLLQHMRYLILLYLYGPDKITDDYCEEI<br>EAWNFGSIVMDNEQLFSEEASMLIQDRIYVNQQIEEGRQSKD<br>TAKVKKNKSKYRMLGDKIEHSINESVVKHYQEACKAVEEK<br>DIPWIKYISDHVMSVYSSKNRVDLDKLSLPYLAKNTWNTWI<br>SFIAMKYVDMGKGVYHFAMSDVDKVGKQDNLIIGQIDPKFS<br>DGISSFDYERIKAEDDLHRSMSGYIAFAVNNFARAICSDEFRK<br>KNRKEDVLTVGLDEIPLYDNVKRKLLQYFGGASNWDDSIIDI<br>IDDKDLVACIKENLYVARNVNFHFAGSEKVQKKQDDILEEIV<br>RKETRDIGKHYRKVFYSNNVAVFYCDEDIIKLMNHLYQREK<br>PYQAQIPSYNKVISKTYLPDLIFMLLKGKNRTKISDPSIMNMF<br>RGTFYFLLKEIYYNDFLQASNLKEMFCEGLKNNVKNKKSEK<br>PYQNFMRRFEELENMGMDFGEICQQIMTDYEQQNKQKKKT<br>ATAVMSEKDKKIRTLDNDTQKYKHFRTLLYIGLREAFIIYLK<br>DEKNKEWYEFLREPVKREQPEEKEFVNKWKLNQYSDCSELI<br>LKDSLAAAWYVVAHFINQAQLNHLIGDIKNYIQFISDIDRRA<br>KSTGNPVSESTEIQIERYRKILRVLEFAKFFCGQITNVLTDYY<br>QDENDFSTHVGHYVKFEKKNMEPAHALQAFSNSLYACGKE<br>KKKAGFYYDGMNPIVNRNITLASMYGNKKLLENAMNPVTE<br>QDIRKYYSLMAELDSVLKNGAVCKSEDEQKNLRHFQNLKN<br>RIELVDVLTLSELVNDLVAQLIGWVYIRERDMMYLQLGLHY<br>IKLYFTDSVAEDSYLRTLDLEEGSIADGAVLYQIASLYSFNLP<br>MYVKPNKSSVYCKKHVNSVATKFDIFEKEYCNGDETVIENG<br>LRLFENINLHKDMVKFRDYLAHFKYFAKLDESILELYSKAYD<br>FFFSYNIKLKKSVSYVLTNVLLSYFINAKLSFSTYKSSGNKTV<br>QHRTTKISVVAQTDYFTYKLRSIVKNKNGVESIENDDRRCEV<br>VNIAARDKEFVDEVCNVINYNSDK (SEQ ID NO: 138) |
| C2-22 | Leptotrichia<br>sp. oral<br>taxon 879<br>str. F0557 | MGNLFGHKRWYEVRDKKDFKIKRKVKVKRNYDGNKYILNI<br>NENNNKEKIDNNKFIGEFVNYKKNNNVLKEFKRKFHAGNIL<br>FKLKGKEEIIRIENNDDFLETEEVVLYIEVYGKSEKLKALEITK<br>KKIIDEAIRQGITKDDKKIEIKRQENEEEIEIDIRDEYTNKTLND<br>CSIILRIIENDELETKKSIYEIFKNIMSLYKIIEKIIENETEKVFE<br>NRYYEEHLREKLLKDNKIDVILTNFMEIREKIKSNLEIMGFVK<br>FYLNVSGDKKKSENKKMFVEKILNTNVDLTVEDIVDFIVKEL<br>KFWNITKRIEKVKKFNNEFLENRRNRTYIKSYVLLDKHEKFK |

TABLE 3-continued

Sequences of C2c2 Species Herein-Identified (See Table 2, Above)

|  |  |  |
| --- | --- | --- |
|  |  | IERENKKDKIVKFFVENIKNNSIKEKIEKILAEFKINELIKKLEK<br>ELKKGNCDTEIFGIFKKHYKVNFDSKKFSNKSDEEKELYKIIY<br>RYLKGRIEKILVNEQKVRLKKMEKIEIEKILNESILSEKILKRV<br>KQYTLEHIMYLGKLRHNDIVKMTVNTDDFSRLHAKEELDLE<br>LITFFASTNMELNKIFNGKEKVTDFFGFNLNGQKITLKEKVPS<br>FKLNILKKLNFINNENNIDEKLSHFYSFQKEGYLLRNKILHNS<br>YGNIQETKNLKGEYENVEKLIKELKVSDEEISKSLSLDVIFEG<br>KVDIINKINSLKIGEYKDKKYLPSFSKIVLEITRKFREINKDKL<br>FDIESEKIILNAVKYVNKILYEKITSNEENEFLKTLPDKLVKKS<br>NNKKENKNLLSIEEYYKNAQVSSSKGDKKAIKKYQNKVTNA<br>YLEYLENTFTEIIDFSKFNLNYDEIKTKIEERKDNKSKIEDSIST<br>NINIITNDIEYIISIFALLNSNTYINKIRNRFFATSVWLEKQNGTK<br>EYDYENIISILDEVLLINLLRENNITDILDLKNAIIDAKIVENDE<br>TYIKNYIFESNEEKLKKRLFCEELVDKEDIRKIFEDENPKFKSF<br>IKKNEIGNFKINFGILSNLECNSEVEAKKIIGKNSKKLESFIQNI<br>IDEYKSNIRTLFSSEFLEKYKEEIDNLVEDTESENKNKFEKIYY<br>PKEHKNELYIYKKNLFLNIGNPNFDKIYGLISKDIKNVDTKIL<br>FDDDIKKNKISEIDAILKNLNDKLNGYSNDYKAKYVNKLKE<br>NDDFFAKNIQNENYSSFGEFEKDYNKVSEYKKIRDLVEFNYL<br>NKIESYLIDINWKLAIQMARFERDMHYIVNGLRELGIIKLSGY<br>NTGISRAYPKRNGSDGFYTTTAYYKFFDEESYKKFEKICYGF<br>GIDLSENSEINKPENESIRNYISHFYIVRNPFADYSIAEQIDRVS<br>NLLSYSTRYNNSTYASVFEVFKKDVNLDYDELKKKFRLIGN<br>NDILERLMKPKKVSVLELESYNSDYIKNLIIELLTKIENTNDTL<br>(SEQ ID NO: 139) |
| C2-23 | Lachno-<br>spiraceae<br>bacterium<br>NK4A144 | MKISKVDHTRMAVAKGNQHRRDEISGILYKDPTKTGSIDFDE<br>RFKKLNCSAKILYHVFNGIAEGSNKYKNIVDKVNNNLDRVL<br>FTGKSYDRKSIIDIDTVLRNVEKINAFDRISTEEREQIIDDLLEI<br>QLRKGLRKGKAGLREVLLIGAGVIVRTDKKQEIADFLEILDE<br>DFNKTNQAKNIKLSIENQGLVVSPVSRGEERIFDVSGAQKGK<br>SSKKAQEKEALSAFLLDYADLDKNVRFEYLRKIRRLINLYFY<br>VKNDDVMSLTEIPAEVNLEKDFDIWRDHEQRKEENGDFVGC<br>PDILLADRDVKKSNSKQVKIAERQLRESIREKNIKRYRFSIKTI<br>EKDDGTYFFANKQISVFWIHRIENAVERILGSINDKKLYRLRL<br>GYLGEKVWKDILNFLSIKYIAVGKAVFNFAMDDLQEKDRDI<br>EPGKISENAVNGLTSFDYEQIKADEMLQREVAVNVAFAANN<br>LARVTVDIPQNGEKEDILLWNKSDIKKYKKNSKKGILKSILQ<br>FFGGASTWNMKMFEIAYHDQPGDYEENYLYDIIQIIYSLRNK<br>SFHFKTYDHGDKNWNRELIGKMIEHDAERVISVEREKFHSN<br>NLPMFYKDADLKKILDLLYSDYAGRASQVPAFNTVLVRKNF<br>PEFLRKDMGYKVHFNNPEVENQWHSAVYYLYKEIYYNLFL<br>RDKEVKNLFYTSLKNIRSEVSDKKQKLASDDFASRCEEIEDR<br>SLPEICQIIMTEYNAQNFGNRKVKSQRVIEKNKDIFRHYKML<br>LIKTLAGAFSLYLKQERFAFIGKATPIPYETTDVKNFLPEWKS<br>GMYASFVEEIKNNLDLQEWYIVGRFLNGRMLNQLAGSLRSY<br>IQYAEDIERRAAENRNKLFSKPDEKIEACKKAVRVLDLCIKIS<br>TRISAEFTDYFDSEDDYADYLEKYLKYQDDAIKELSGSSYAA<br>LDHFCNKDDLKFDIYVNAGQKPILQRNIVMAKLFGPDNILSE<br>VMEKVTESAIREYYDYLKKVSGYRVRGKCSTEKEQEDLLKF<br>QRLKNAVEFRDVTEYAEVINELLGQLISWSYLRERDLLYFQL<br>GPHYMCLKNKSFKPAEYVDIRRNNGTIIHNAILYQIVSMYIN<br>GLDFYSCDKEGKTLKPIETGKGVGSKIGQFIKYSQYLYNDPS<br>YKLEIYNAGLEVFENIDEHDNITDLRKYVDHFKYYAYGNKM<br>SLLDLYSEFFDRFFTYDMKYQKNVVNVLENILLRHFVIFYPK<br>FGSGKKDVGIRDCKKERAQIEISEQSLTSEDFMFKLDDKAGE<br>EAKKFPARDERYLQTIAKLLYYPNEIEDMNRFMKKGETINK<br>KVQFNRKKKITRKQKNNSSNEVLSSTMGYLFKNIKL<br>(SEQ ID NO: 140) |
| C2-24 | Chloroflexus<br>aggregans | MTDQVRREEVAAGELADTPLAAAQTPAADAAVAATPAPAE<br>AVAPTPEQAVDQPATTGESEAPVTTAQAAAHEAEPAEATGA<br>SFTPVSEQQPQKPRRLKDLQPGMELEGKVTSIALYGIFVDVG<br>VGRDGLVHISEMSDRRIDTPSELVQIGDTVKVWVKSVDLDA<br>RRISLTMLNPSRGEKPRRSRQSQPAQPQPRRQEVDREKLASL<br>KVGEIVEGVITGFAPFGAFADIGVGKDGLIHISELSEGRVEKP<br>EDAVKVGERYQFKVLEIDGEGTRISLSLRRAQRTQRMQQLEP<br>GQIIEGTVSGIATFGAFVDIGVGRDGLVHISALAPHRVAKVED<br>VVKVGDKVKVKVLGVDPQSKRISLTMRLEEEQPATTAGDEA<br>AEPAEEVTPTRRGNLERFAAAAQTARERSERGERSERGERRE<br>RRERRPAQSSPDTYIVGEDDDESFEGNATIEDLLTKFGGSSSR<br>RDRDRRRRHEDDDDEEMERPSNRRQREAIRRTLQQIGYDE<br>(SEQ ID NO: 141) |
| C2-25 | Demequina<br>aurantiaca | MDLTWHALLILFIVALLAGFLDTLAGGGGLLTVPALLLTGIP<br>PLQALGTNKLQSSFGTGMATYQVIRKKRVHWRDVRWPMV<br>WAFLGSAAGAVAVQFIDTDALLIIIPVVLALVAAYFLFVPKS<br>HLPPPEPRMSDPAYEATLVPIIGAYDGAFGPGTGSLYALSGV |

TABLE 3-continued

Sequences of C2c2 Species Herein-Identified (See Table 2, Above)

| | | |
|---|---|---|
| | | ALRAKTLVQSTAIAKTLNFATNFAALLVFAFAGHMLWTVGA<br>VMIAGQLIGAYAGSHMLFRVNPLVLRVLIVVMSLGMLIRVL<br>LD (SEQ ID NO: 142) |
| C2-26 | *Thalassospira*<br>sp.<br>TSL5-1 | MRIIKPYGRSHVEGVATQEPRRKLRLNSSPDISRDIPGFAQSH<br>DALIIAQWISAIDKIATKPKPDKKPTQAQINLRTTLGDAAWQ<br>HVMAENLLPAATDPAIREKLHLIWQSKIAPWGTARPQAEKD<br>GKPTPKGGWYERFCGVLSPEAITQNVARQIAKDIYDHLHVA<br>AKRKGREPAKQGESSNKPGKFKPDRKRGLIEERAESIAKNAL<br>RPGSHAPCPWGPDDQATYEQAGDVAGQIYAAARDCLEEKK<br>RRSGNRNTSSVQYLPRDLAAKILYAQYGRVFGPDTTIKAALD<br>EQPSLFALHKAIKDCYHRLINDARKRDILRILPRNMAALFRL<br>VRAQYDNRDINALIRLGKVIHYHASEQGKSEHHGIRDYWPS<br>QQDIQNSRFWGSDGQADIKRHEAFSRIWRHIIALASRTLHDW<br>ADPHSQKFSGENDDILLLAKDAIEDDVFKAGHYERKCDVLF<br>GAQASLFCGAEDFEKAILKQAITGTGNLRNATFHFKGKVRFE<br>KELQELTKDVPVEVQSAIAALWQKDAEGRTRQIAETLQAVL<br>AGHFLTEEQNRHIFAALTAAMAQPGDVPLPRLRRVLARHDSI<br>CQRGRILPLSPCPDRAKLEESPALTCQYTVLKMLYDGPFRAW<br>LAQQNSTILNHYIDSTIARTDKAARDMNGRKLAQAEKDLITS<br>RAADLPRLSVDEKMGDFLARLTAATATEMRVQRGYQSDGE<br>NAQKQAAFIGQFECDVIGRAFADFLNQSGFDFVLKLKADTP<br>QPDAAQCDVTALIAPDDISVSPPQAWQQVLYFILHLVPVDDA<br>SHLLHQIRKWQVLEGKEKPAQIAHDVQSVLMLYLDMHDAK<br>FTGGAALHGIEKFAEFFAHAADFRAVFPPQSLQDQDRSIPRR<br>GLREIVRFGHLPLLQHMSGTVQITHDNVVAWQAARTAGAT<br>GMSPIARRQKQREELHALAVERTARFRNADLQNYMHALVD<br>VIKHRQLSAQVTLSDQVRLHRLMMGVLGRLVDYAGLWERD<br>LYFVVLALLYHHGATPDDVFKGQGKKNLADGQVVAALKPK<br>NRKAAAPVGVFDDLDHYGIYQDDRQSIRNGLSHFNMLRGG<br>KAPDLSHWVNQTRSLVAHDRKLKNAVAKSVIEMLAREGFD<br>LDWGIQTDRGQHILSHGKIRTRQAQHFQKSRLHIVKKSAKPD<br>KNDTVKIRENLHGDAMVERVVQLFAAQVQKRYDITVEKRL<br>DHLFLKPQDQKGKNGIHTHNGWSKTEKKRRPSRENRKGNH<br>EN (SEQ ID NO: 143) |
| C2-27 | SAMN04487830_<br>13920<br>[*Pseudo-<br>butyrivibrio*<br>sp. OR37] | MKFSKESHRKTAVGVTESNGIIGLLYKDPLNEKEKIEDVVNQ<br>RANSTKRLFNLFGTEATSKDISRASKDLAKVVNKAIGNLKGN<br>KKFNKKEQITKGLNTKIIVEELKNVLKDEKKLIVNKDIIDEAC<br>SRLLKTSFRTAKTKQAVKMILTAVLIENTNLSKEDEAFVHEY<br>FVKKLVNEYNKTSVKKQIPVALSNQNMVIQPNSVNGTLEISE<br>TKKSKETKTTEKDAFRAFLRDYATLDENRRHKMRLCLRNLV<br>NLYFYGETSVSKDDFDEWRDHEDKKQNDELFVKKIVSIKTD<br>RKGNVKEVLDVDATIDAIRTNNIACYRRALAYANENPDVFF<br>SDTMLNKFWIHHVENEVERIYGHINNNTGDYKYQLGYLSEK<br>VWKGIINYLSIKYIAEGKAVYNYAMNALAKDNNSNAFGKLD<br>EKFVNGITSFEYERIKAEETLQRECAVNIAFAANHLANATVD<br>LNEKDSDFLLLKHEDNKDTLGAVARPNILRNILQFFGGKSRW<br>NDFDFSGIDEIQLLDDLRKMIYSLRNSSFHFKTENIDNDSWNT<br>KLIGDMFAYDFNMAGNVQKDKMYSNNVPMFYSTSDIEKML<br>DRLYAEVHERASQVPSFNSVFVRKNFPDYLKNDLKITSAFGV<br>DDALKWQSAVYYVCKEIYYNDFLQNPETFTMLKDYVQCLPI<br>DIDKSMDQKLKSERNAHKNFKEAFATYCKECDSLSAICQMI<br>MTEYNNQNKGNRKVISARTKDGDKLIYKHYKMILFEALKN<br>VFTIYLEKNINTYGFLKKPKLINNVPAIEEFLPNYNGRQYETL<br>VNRITEETELQKWYIVGRLLNPKQVNQLIGNFRSYVQYVND<br>VARRAKQTGNNLSNDNIAWDVKNIIQIFDVCTKLNGVTSNIL<br>EDYFDDGDDYARYLKNFVDYTNKNNDHSATLLGDFCAKEI<br>DGIKIGIYHDGTNPIVNRNIIQCKLYGATGIISDLTKDGSILSV<br>DYEIIKKYMQMQKEIKVYQQKGICKTKEEQQNLKKYQELKN<br>IVELRNIIDYSEILDELQGQLINWGYLRERDLMYFQLGFHYLC<br>LHNESKKPVGYNNAGDISGAVLYQIVAMYTNGLSLIDANGK<br>SKKNAKASAGAKVGSFCSYSKEIRGVDKDTKEDDDPIYLAG<br>VELFENINEHQQCINLRNYIEHFHYYAKHDRSMLDLYSEVFD<br>RFFTYDMKYTKNVPNMMYNILLQHLVVPAFEFGSSEKRLDD<br>NDEQTKPRAMFTLREKNGLSSEQFTYRLGDGNSTVKLSARG<br>DDYLRAVASLLYYPDRAPEGLIRDAEAEDKFAKINHSNPKSD<br>NRNNRGNFKNPKVQWYNNKTKRK (SEQ ID NO: 144) |
| C2-28 | SAMN02910398_<br>00008<br>[*Butyrivibrio*<br>sp.<br>YAB3001] | MKISKVDHRKTAVKITDNKGAEGFIYQDPTRDSSTMEQIISN<br>RARSSKVLFNIFGDTKKSKDLNKYTESLIIYVNKAIKSLKGDK<br>RNNKYEEITESLKTERVLNALIQAGNEFTCSENNIEDALNKY<br>LKKSFRVGNTKSALKKLLMAAYCGYKLSIEEKEEIQNYFVD<br>KLVKEYNKDTVLKYTAKSLKHQNMVVQPDTDNHVFLPSRI<br>AGATQNKMSEKEALTEFLKAYAVLDEEKRHNLRIILRKLVN<br>LYFYESPDFIYPENNEWKEHDDRKNKTETFVSPVKVNEEKN<br>GKTFVKIDVPATKDLIRLKNIECYRRSVAETAGNPITYFTDHN<br>ISKFWIHHIENEVEKIFALLKSNWKDYQFSVGYISEKVWKEII |

TABLE 3-continued

Sequences of C2c2 Species Herein-Identified (See Table 2, Above)

|  |  |  |
|---|---|---|
|  |  | NYLSIKYIAIGKAVYNYALEDIKKNDGTLNFGVIDPSFYDGIN<br>SFEYEKIKAEETFQREVAVYVSFAVNHLSSATVKLSEAQSDM<br>LVLNKNDIEKIAYGNTKRNILQFFGGQSKWKEFDFDRYINPV<br>NYTDIDFLFDIKKMVYSLRNESFHFTTTDTESDWNKNLISAM<br>FEYECRRISTVQKNKFFSNNLPLFYGENSLERVLHKLYDDYV<br>DRMSQVPSFGNVFVRKKFPDYMKEIGIKHNLSSEDNLKLQG<br>ALYFLYKEIYYNAFISSEKAMKIFVDLVNKLDTNARDDKGRI<br>THEAMAHKNFKDAISHYMTHDCSLADICQKIMTEYNQQNT<br>GHRKKQTTYSSEKNPEIFRHYKMILFMLLQKAMTEYISSEEIF<br>DFIMKPNSPKTDIKEEEFLPQYKSCAYDNLIKLIADNVELQK<br>WYITARLLSPREVNQLIGSFRSYKQFVSDIERRAKETNNSLSK<br>SGMTVDVENITKVLDLCTKLNGRFSNELTDYFDSKDDYAVY<br>VSKFLDFGFKIDEKFPAALLGEFCNKEENGKKIGIYHNGTEPI<br>LNSNIIKSKLYGITDVVSRAVKPVSEKLIREYLQQEVKIKPYL<br>ENGVCKNKEEQAALRKYQELKNRIEFRDIVEYSEIINELMGQ<br>LINFSYLRERDLMYFQLGFHYLCLNNYGAKPEGYYSIVNDK<br>RTIKGAILYQIVAMYTYGLPIYHYVDGTISDRRKNKKTVLDT<br>LNSSETVGAKIKYFIYYSDELFNDSLILYNAGLELFENINEHE<br>NIVNLRKYIDHFKYYVSQDRSLLDIYSEVFDRYFTYDRKYKK<br>NVMNLFSNIMLKHFIITDFEFSTGEKTIGEKNTAKKECAKVRI<br>KRGGLSSDKFTYKFKDAKPIELSAKNTEFLDGVARILYYPEN<br>VVLTDLVRNSEVEDEKRIEKYDRNHNSSPTRKDKTYKQDVK<br>KNYNKKTSKAFDSSKLDTKSVGNNLSDNPVLKQFLSESKKK<br>R (SEQ ID NO: 145) |
| C2-29 | *Blautia* sp.<br>Marseille-<br>P2398 | MKISKVDHVKSGIDQKLSSQRGMLYKQPQKKYEGKQLEEH<br>VRNLSRKAKALYQVFPVSGNSKMEKELQIINSFIKNILLRLDS<br>GKTSEEIVGYINTYSVASQISGDHIQELVDQHLKESLRKYTCV<br>GDKRIYVPDIIVALLKSKFNSETLQYDNSELKILIDFIREDYLK<br>EKQIKQIVHSIENNSTPLRIAEINGQKRLIPANVDNPKKSYIFE<br>FLKEYAQSDPKGQESLLQHMRYLILLYLYGPDKITDDYCEEI<br>EAWNFGSIVMDNEQLFSEEASMLIQDRIYVNQQIEEGRQSKD<br>TAKVKKNKSKYRMLGDKIEHSINESVVKHYQEACKAVEEK<br>DIPWIKYISDHVMSVYSSKNRVDLDKLSLPYLAKNTWNTWI<br>SFIAMKYVDMGKGVYHFAMSDVDKVGKQDNLIIGQIDPKFS<br>DGISSFDYERIKAEDDLHRSMSGYIAFAVNNFARAICSDEFRK<br>KNRKEDVLTVGLDEIPLYDNVKRKLLQYFGGASNWDDSIIDI<br>IDDKDLVACIKENLYVARNVNFHFAGSEKVQKKQDDILEEIV<br>RKETRDIGKHYRKVFYSNNVAVFYCDEDIIKLMNHLYQREK<br>PYQAQIPSYNKVISKTYLPDLIFMLLKGKNRTKISDPSIMNMF<br>RGTFYFLLKEIYYNDFLQASNLKEMFCEGLKNNVKNKKSEK<br>PYQNFMRRFEELENMGMDFGEICQQIMTDYEQQNKQKKT<br>ATAVMSEKDKKIRTLDNDTQKYKHFRTLLYIGLREAFIIYLK<br>DEKNKEWYEFLREPVKREQPEEKEFVNKWKLNQYSDCSELI<br>LKDSLAAAWYVVAHFINQAQLNHLIGDIKNYIQFISDIDRRA<br>KSTGNPVSESTEIQIERYRKILRVLEFAKFFCGQITNVLTDYY<br>QDENDFSTHVGHYVKFEKKNMEPAHALQAFSNSLYACGKE<br>KKKAGFYYDGMNPIVNRNITLASMYGNKKLLENAMNPVTE<br>QDIRKYYSLMAELDSVLKNGAVCKSEDEQKNLRHFQNLKN<br>RIELVDVLTLSELVNDLVAQLIGWVYIRERDMMYLQLGLHY<br>IKLYFTDSVAEDSYLRTLDLEEGSIADGAVLYQIASLYSFNLP<br>MYVKPNKSSVYCKKHVNSVATKFDIFEKEYCNGDETVIENG<br>LRLFENINLHKDMVKFRDYLAHFKYFAKLDESILELYSKAYD<br>FFFSYNIKLKKSVSYVLTNVLLSYFINAKLSFSTYKSSGNKTV<br>QHRTTKISVVAQTDYFTYKLRSIVKNKNGVESIENDDRRCEV<br>VNIAARDKEFVDEVCNVINYNSDK (SEQ ID NO: 146) |
| C2-30 | *Leptotrichia*<br>sp.<br>Marseille-<br>P3007 | MKITKIDGISHKKYIKEGKLVKSTSEENKTDERLSELLTIRLD<br>TYIKNPDNASEEENRIRRENLKEFFSNKVLYLKDGILYLKDR<br>REKNQLQNKNYSEEDISEYDLKNKNNFLVLKKILLNEDINSE<br>ELEIFRNDFEKKLDKINSLKYSLEENKANYQKINENNIKKVE<br>GKSKRNIFYNYYKDSAKRNDYINNIQEAFDKLYKKEDIENLF<br>FLIENSKKHEKYKIRECYHKIIGRKNDKENFATIIYEEIQNVNN<br>MKELIEKVPNVSELKKSQVFYKYYLNKEKLNDENIKYVFCH<br>FVEIEMSKLLKNYVYKKPSNISNDKVKRIFEYQSLKKLIENKL<br>LNKLDTYVRNCGKYSFYLQDGEIATSDFIVGNRQNEAFLRNI<br>IGVSSTAYFSLRNILETENENDITGRMRGKTVKNNKGEEKYIS<br>GEIDKLYDNNKQNEVKKNLKMFYSYDFNMNSKKEIEDFFSN<br>IDEAISSIRHGIVHFNLELEGKDIFTFKNIVPSQISKKMFHDEIN<br>EKKLKLKIFKQLNSANVFRYLEKYKILNYLNRTRFEFVNKNI<br>PFVPSFTKLYSRIDDLKNSLGIYWKTPKTNDDNKTKEITDAQI<br>YLLKNIYYGEFLNYFMSNNGNFFEITKEBELNKNDKRNLKT<br>GFYKLQKFENLQEKTPKEYLANIQSLYMINAGNQDEEEKDT<br>YIDFIQKIFLKGFMTYLANNGRLSLIYIGSDEETNTSLAEKKQ<br>EFDKFLKKYEQNNNIEIPYEINEFVREIKLGKILKYTERLNMF<br>YLILKLLNHKELTNLKGSLEKYQSANKEEAFSDQLELINLLN<br>LDNNRVTEDFELEADEIGKFLDFNGNKVKDNKELKKFDTNK<br>IYFDGENIIKHRAFYNIKKYGMLNLLEKISDEAKYKISIEELKN |

TABLE 3-continued

Sequences of C2c2 Species Herein-Identified (See Table 2, Above)

|||
|---|---|
| | YSKKKNEIEENHTTQENLHRKYARPRKDEKFTDEDYKKYEK<br>AIRNIQQYTHLKNKVEFNELNLLQSLLLRILHRLVGYTSIWER<br>DLRFRLKGEFPENQYIEEIFNFDNSKNVKYKNGQIVEKYINFY<br>KELYKDDTEKISIYSDKKVKELKKEKKDLYIRNYIAHFNYIPN<br>AEISLLEMLENLRKLLSYDRKLKNAIMKSIVDILKEYGFVVTF<br>KIEKDKKIRIESLKSEEVVHLKKLKLKDNDKKKEPIKTYRNS<br>KELCKLVKVMFEYKMKEKKSEN (SEQ ID NO: 147) |
| C2-31 | *Bacteroides<br>ihuae* | MRITKVKVKESSDQKDKMVLIHRKVGEGTLVLDENLADLTA<br>PIIDKYKDKSFELSLLKQTLVSEKEMNIPKCDKCTAKERCLSC<br>KQREKRLKEVRGAIEKTIGAVIAGRDIIPRLNIFNEDEICWLIK<br>PKLRNEFTFKDVNKQVVKLNLPKVLVEYSKKNDPTLFLAYQ<br>QWIAAYLKNKKGHIKKSILNNRVVIDYSDESKLSKRKQALEL<br>WGEEYETNQRIALESYHTSYNIGELVTLLPNPEEYVSDKGEIR<br>PAFHYKLKNVLQMHQSTVFGTNEILCINPIFNENRANIQLSAY<br>NLEVVKYFEHYFPIKKKKKNLSLNQAIYYLKVETLKERLSLQ<br>LENALRMNLLQKGKIKKHEFDKNTCSNTLSQIKRDEFFVLNL<br>VEMCAFAANNIRNIVDKEQVNEILSKKDLCNSLSKNTIDKEL<br>CTKFYGADFSQIPVAIWAMRGSVQQIRNEIVHYKAEAIDKIF<br>ALKTFEYDDMEKDYSDTPFKQYLELSIEKIDSFFIEQLSSNDV<br>LNYYCTEDVNKLLNKCKLSLRRTSIPFAPGFKTIYELGCHLQ<br>DSSNTYRIGHYLMLIGGRVANSTVTKASKAYPAYRFMLKLI<br>YNHLFLNKFLDNHNKRFFMKAVAFVLKDNRENARNKFQYA<br>FKEIRMMNNDESIASYMSYIHSLSVQEQEKKGDKNDKVRYN<br>TEKFPIEKVFVKGFDDFLSWLGVEFILSPNQEERDKTVTREEYE<br>NLMIKDRVEHSINSNQESHIAFFTFCKLLDANHLSDLRNEWI<br>KFRSSGDKEGFSYNFAIDIIELCLLTVDRVEQRRDGYKEQTEL<br>KEYLSFFIKGNESENTVWKGFYFQQDNYTPVLYSPIELIRKY<br>GTLELLKLIIVDEDKITQGEFEEWQTLKKVVEDKVTRRNELH<br>QEWEDMKNKSSFSQEKCSIYQKLCRDIDRYNWLDNKLHLV<br>HLRKLHNLVIQILSRMARFIALWDRDFVLLDASRANDDYKL<br>LSFFNFRDFINAKKTKTDDELLAEFGSKIEKKNAPFIKAEDVP<br>LMVECIEAKRSFYQKVFFRNNLQVLADRNFIAHYNYISKTAK<br>CSLFEMIIKLRTLMYYDRKLRNAVVKSIANVFDQNGMVLQL<br>SLDDSHELKVDKVISKRIVHLKNNNEVITDQVPEEYYKICRRL<br>LEMKK (SEQ ID NO: 148) |
| C2-32 | SAMN05216357_<br>1045<br>[*Porphyro-<br>monadaceae<br>bacterium<br>KH3CP3RA*] | MEFRDSIFKSLLQKEIEKAPLCFAEKLISGGVFSYYPSERLKEF<br>VGNHPFSLFRKTMPFSPGFKRVMKSGGNYQNANRDGRFYD<br>LDIGVYLPKDGFGDEEWNARYFLMKLIYNQLFLPYFADAEN<br>HLFRECVDFVKRVNRDYNCKNNNSEEQAFIDIRSMREDESIA<br>DYLAFIQSNIIIEENKKKETNKEGQINFNKFLLQVFVKGFDSFL<br>KDRTELNFLQLPELQGDGTRGDDLESLDKLGAVVAVDLKLD<br>ATGIDADLNENISFYTFCKLLDSNHLSRLRNEIIKYQSANSDF<br>SHNEDFDYDRIISIIELCMLSADHVSTNDNESIFPNNDKDFSGI<br>RPYLSTDAKVETFEDLYVHSDAKTPITNATMVLNWKYGTDK<br>LFERLMISDQDFLVTEKDYFVWKELKKDIEEKIKLREELHSL<br>WVNTPKGKKGAKKKNGRETTGEFSEENKKEYLEVCREIDRY<br>VNLDNKLHFVHLKRMHSLLIELLGRFVGFTYLFERDYQYYH<br>LEIRSRRNKDAGVVDKLEYNKIKDQNKYDKDDFFACTFLYE<br>KANKVRNFIAHFNYLTMWNSPQEEEHNSNLSGAKNSSGRQN<br>LKCSLTELINELREVMSYDRKLKNAVTKAVIDLFDKHGMVI<br>KFRIVNNNNDNKNKHHLELDDIVPKKIMHLRGIKLKRQDG<br>KPIPIQTDSVDPLYCRMWKKLLDLKPTPF (SEQ ID NO: 149) |
| C2-33 | *Listeria<br>riparia* | MHDAWAENPKKPQSDAFLKEYKACCEAIDTYNWHKNKAT<br>LVYVNELHHLLIDILGRLVGYVAIADRDFQCMANQYLKSSG<br>HTERVDSWINTIRKNRPDYIEKLDIFMNKAGLFVSEKNGRNY<br>IAHLNYLSPKHKYSLLYLFEKLREMLKYDRKLKNAVTKSLID<br>LLDKHGMCVVFANLKNNKHRLVIASLKPKKIETFKWKKIK<br>(SEQ ID NO: 150) |
| C2-34 | *Insolitis-<br>pinillum<br>peregrinum* | MRIIRPYGSSTVASPSPQDAQPLRSLQRQNGTFDVAEFSRRHP<br>ELVLAQWVAMLDKIIRKPAPGKNSTALPRPTAEQRRLRQQV<br>GAALWAEMQRHTPVPPELKAVWDSKVHPYSKDNAPATAKT<br>PSHRGRWYDRFGDPETSAATVAEGVRRHLLDSAQPFRANGG<br>QPKGKGVIEHRALTIQNGTLLHHHQSEKAGPLPEDWSTYRA<br>DELVSTIGKDARWIKVAASLYQHYGRIFGPTTPISEAQTRPEF<br>VLHTAVKAYYRRLFKERKLPAERLERLLPRTGEALRHAVTV<br>QHGNRSLADAVRIGKILHYGWLQNGEPDPWPDDAALYSSR<br>YWGSDGQTDIKHSEAVSRVWRRALTAAQRTLTSWLYPAGT<br>DAGDILLIGQKPDSIDRNRLPLLYGDSTRHWTRSPGDVWLFL<br>KQTLENLRNSSFHPKTLSAFTSHLDGTCESEPAEQQAAQALW<br>QDDRQQDHQQVFLSLRALDATTYLPTGPLHRIVNAVQSTDA<br>TLPLPRFRRVVTRAANTRLKGFPVEPVNRRTMEDDPLLRCR<br>YGVLKLLYERGFRAWLETRPSIASCLDQSLKRSTKAAQTING<br>KNSPQGVEILSRATKLLQAEGGGGHGIHDLFDRLYAATARE<br>MRVQVGYHHDAEAARQQAEFIEDLKCEVVARAFCAYLKTL |

TABLE 3-continued

Sequences of C2c2 Species Herein-Identified (See Table 2, Above)

```
GIQGDTFRRQPEPLPTWPDLPDLPSSTIGTAQAALYSVLHLMP
VEDVGSLLHQLRRWLVALQARGGEDGTAITATIPLLELYLN
RHDAKFSGGGAGTGLRWDDWQVFFDCQATFDRVFPPGPAL
DSHRLPLRGLREVLRFGRVNDLAALIGQDKITAAEVDRWHT
AEQTIAAQQQRREALHEQLSRKKGTDAEVDEYRALVTAIAD
HRHLTAHVTLSNVVRLHRLMTTVLGRLVDYGGLWERDLTF
VTLYEAHRLGGLRNLLSESRVNKFLDGQTPAALSKKNNAEE
NGMISKVLGDKARRQIRNDFAHFNMLQQGKKTINLTDEINN
ARKLMAHDRKLKNAITRSVTTLLQQDGLDIVWTMDASHRL
TDAKIDSRNAIHLHKTHNRANIREPLHGKSYCRWVAALFGA
TSTPSATKKSDKIR (SEQ ID NO: 151)
```

Example 3: Characterization of Cas13b Orthologs

Figure 6A:
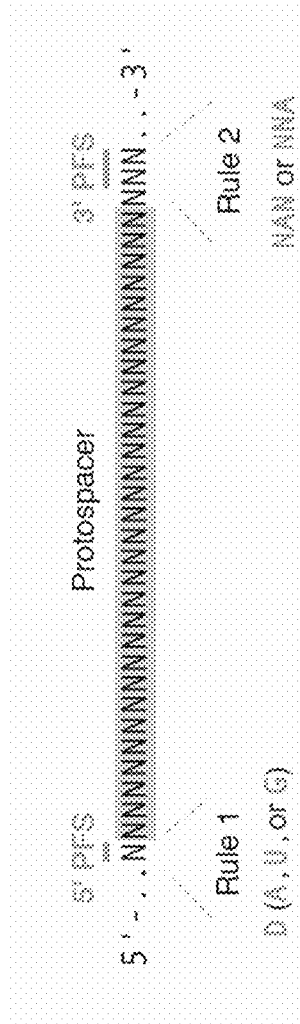
FIG. 6A-6B (A) shows the protospacer design for MS2 phage drop plaque assay to test RNA interference and identify PFS. (B) shows RNA interference assay schematic. A target sequence is placed in-frame at the start of the transcribed bla gene that confers ampicillin resistance or in a non-transcribed region on the opposite strand of the same target plasmid. Target plasmids were co-transformed with bzcas13b plasmid or empty vectors conferring chloramphenicol resistance and plated on double selection antibiotic plates. Depleted colonies were identified and corresponding targets sequenced for PFS identification.
Figure 6B:
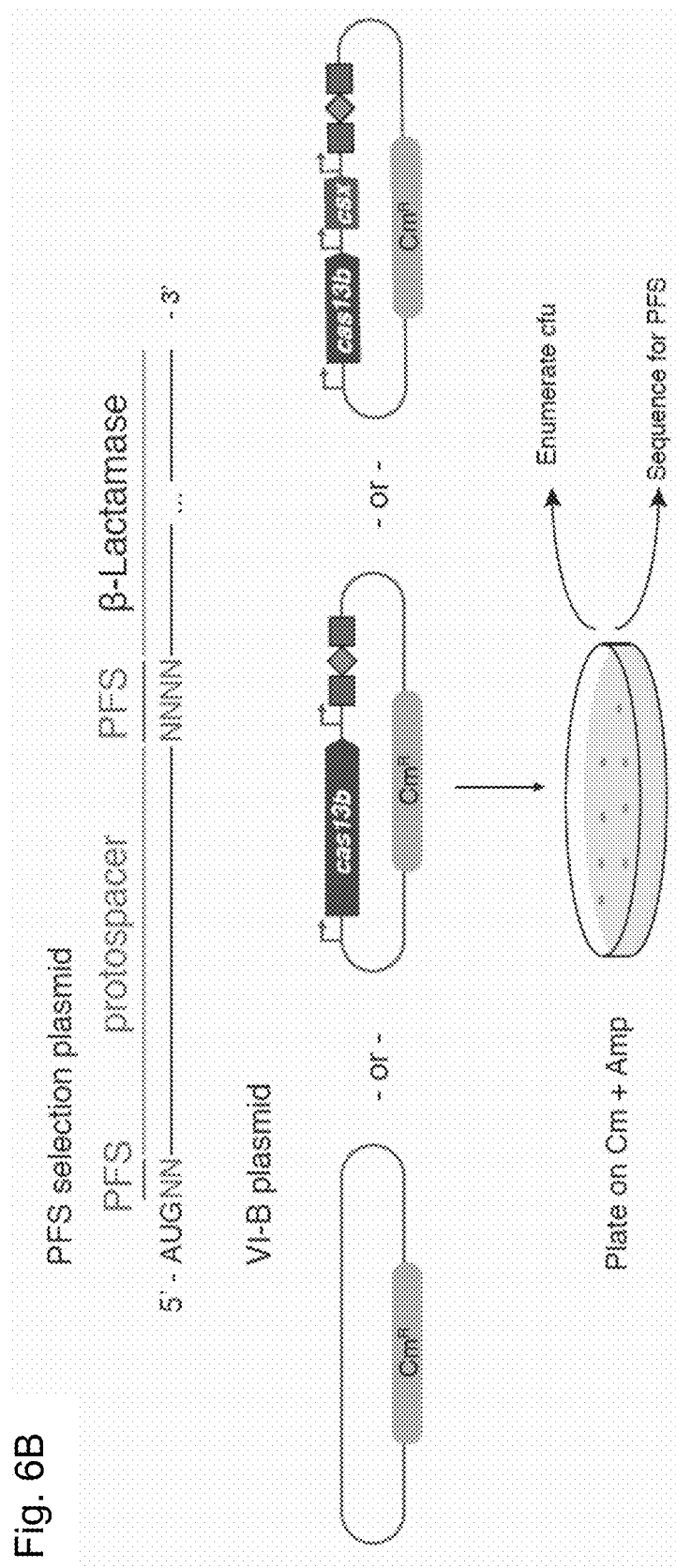
Figure 7:
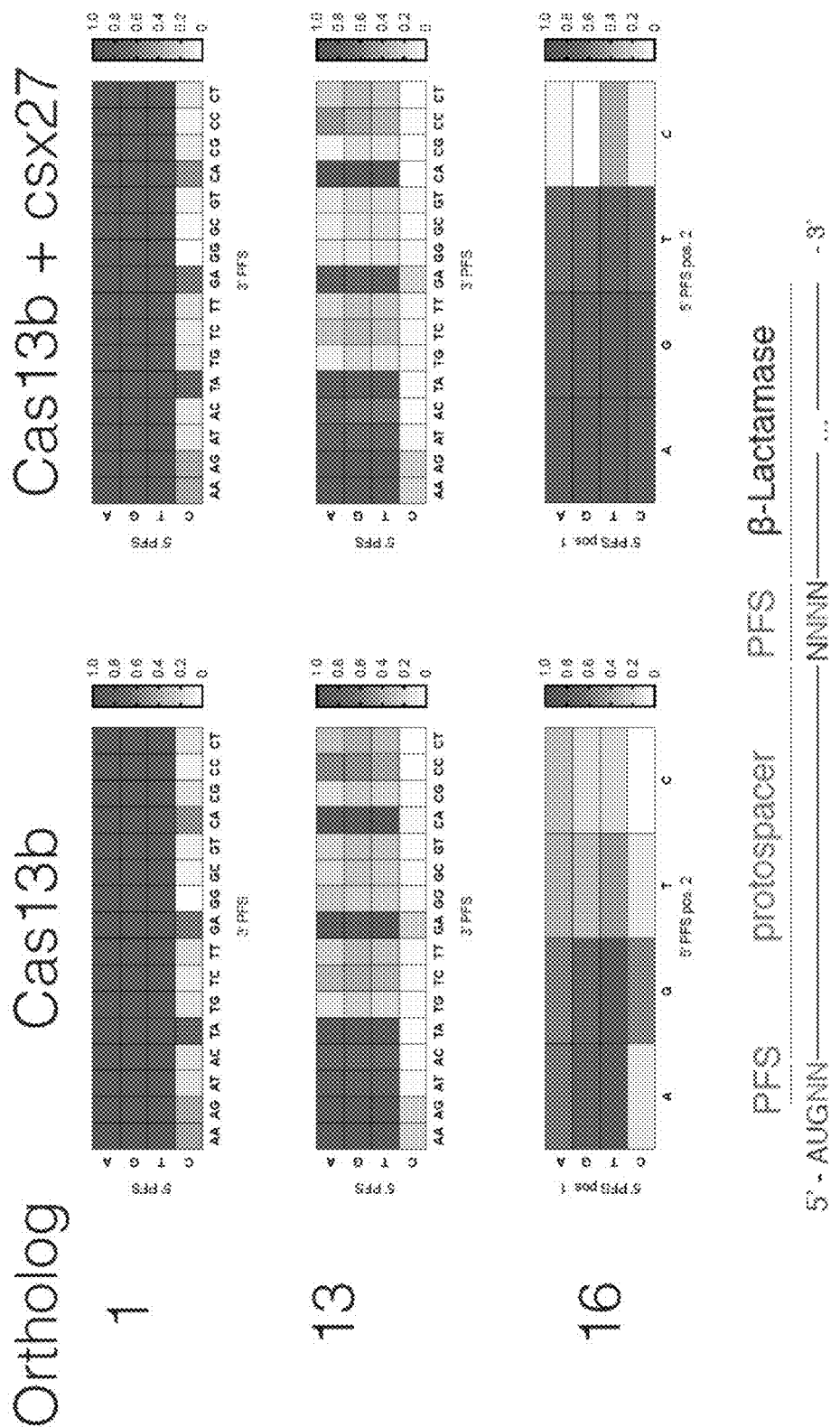
FIG. 7 shows the heatmap of the normalized PFS score from safely depleted spacers for orthologs 1, 13 and 16 in the absence and presence of the csx27 accessory protein.
Figure 8:
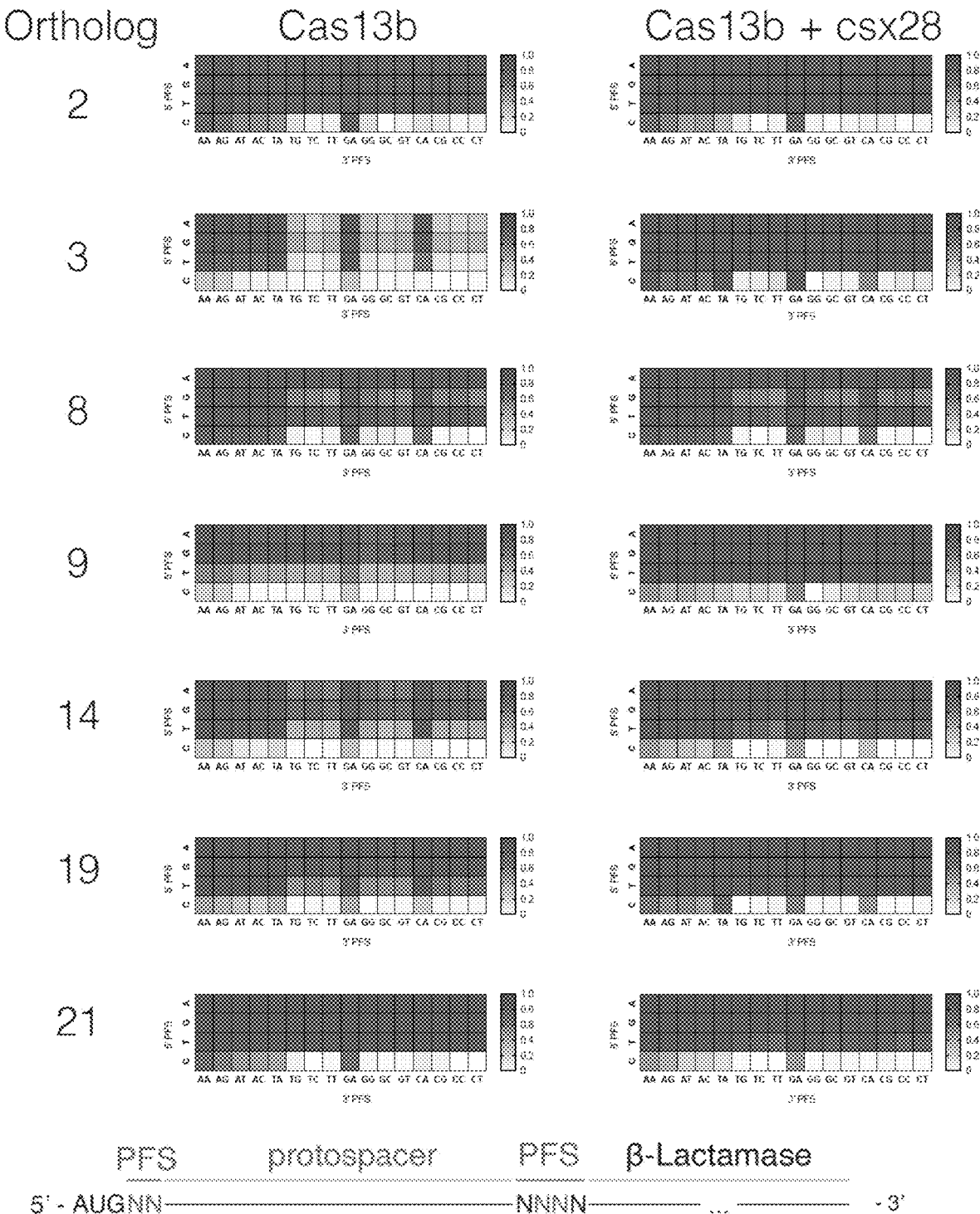
FIG. 8 shows the heatmap of the normalized PFS score from safely depleted spacers for orthologs 2, 3, 8, 9, 14, 19 and 21 in the absence and presence of the csx28 accessory protein.
Figure 9:
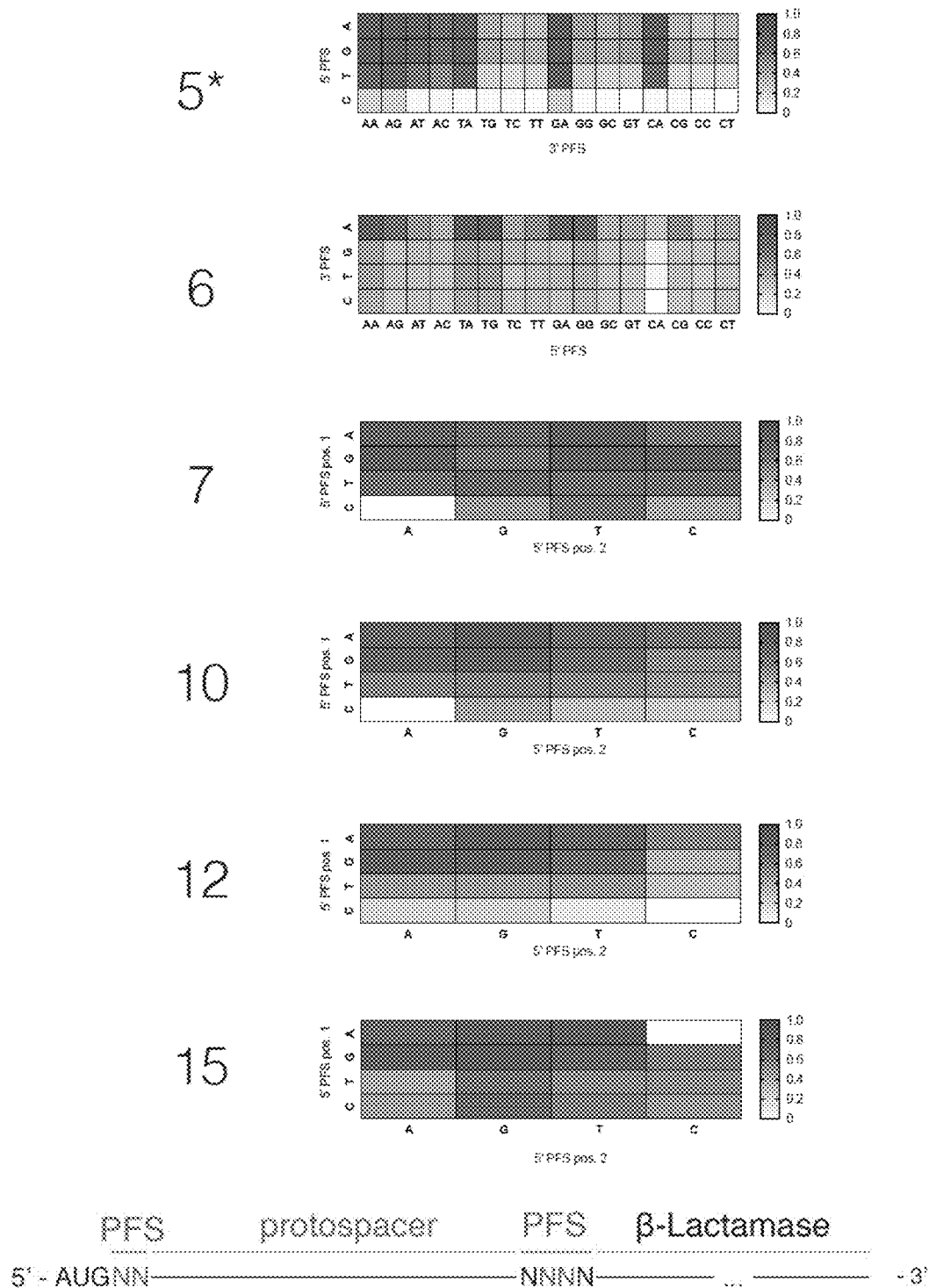
FIG. 9 shows the heatmap of the normalized PFS score from safely depleted spacers for orthologs 5, 6, 7, 10, 12 and 15.
Figure 10A:
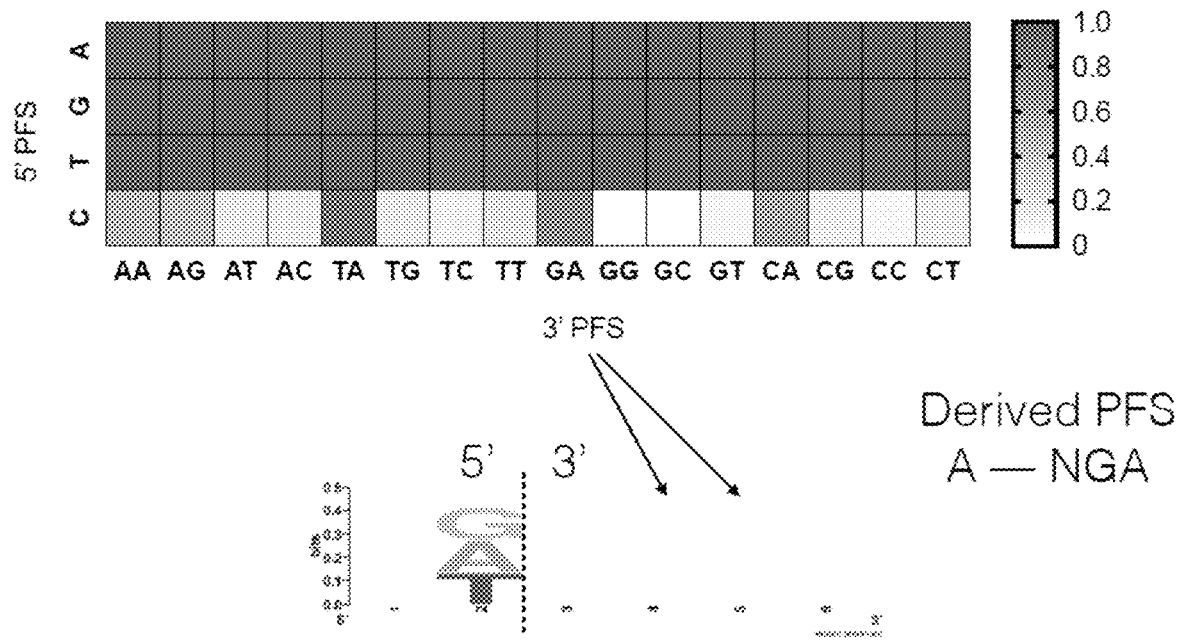
FIG. 10A-10BB shows the heatmap of the normalized PFS score from safely depleted spacers for different orthologs and the derived PFS.
Figure 10B:
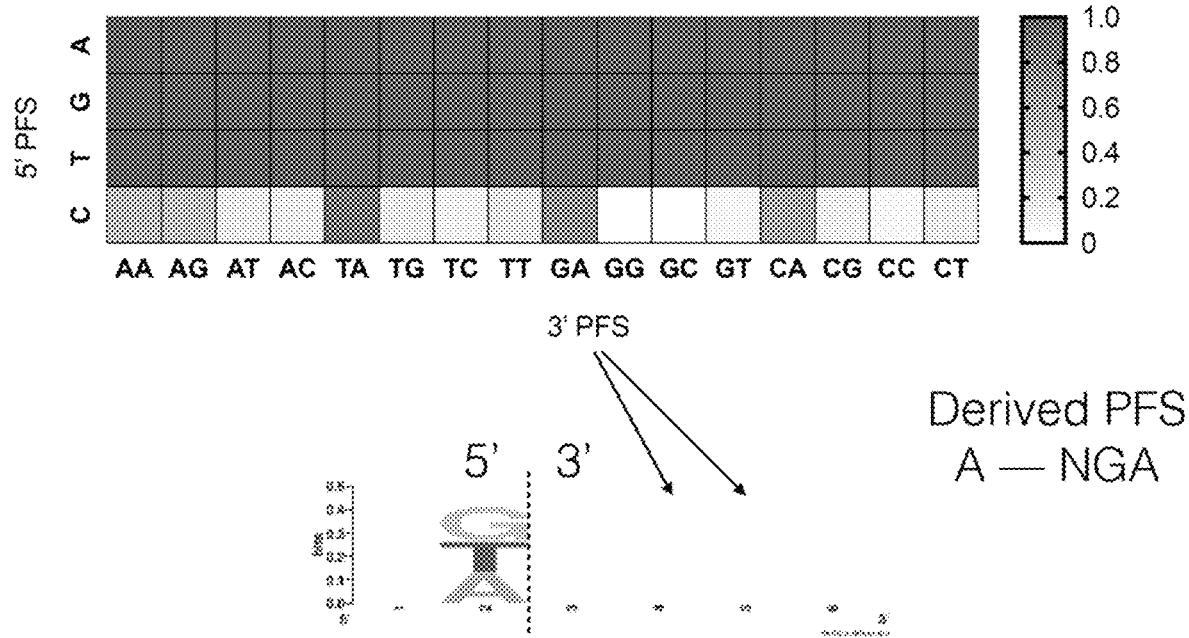
Figure 10C:
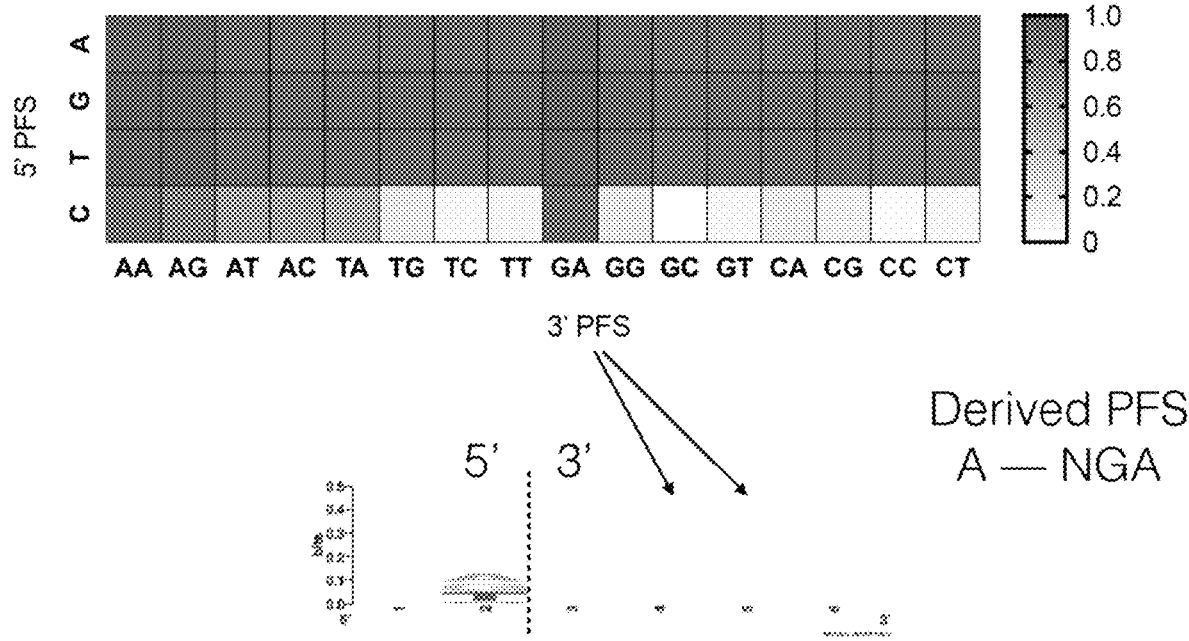
Figure 10D:
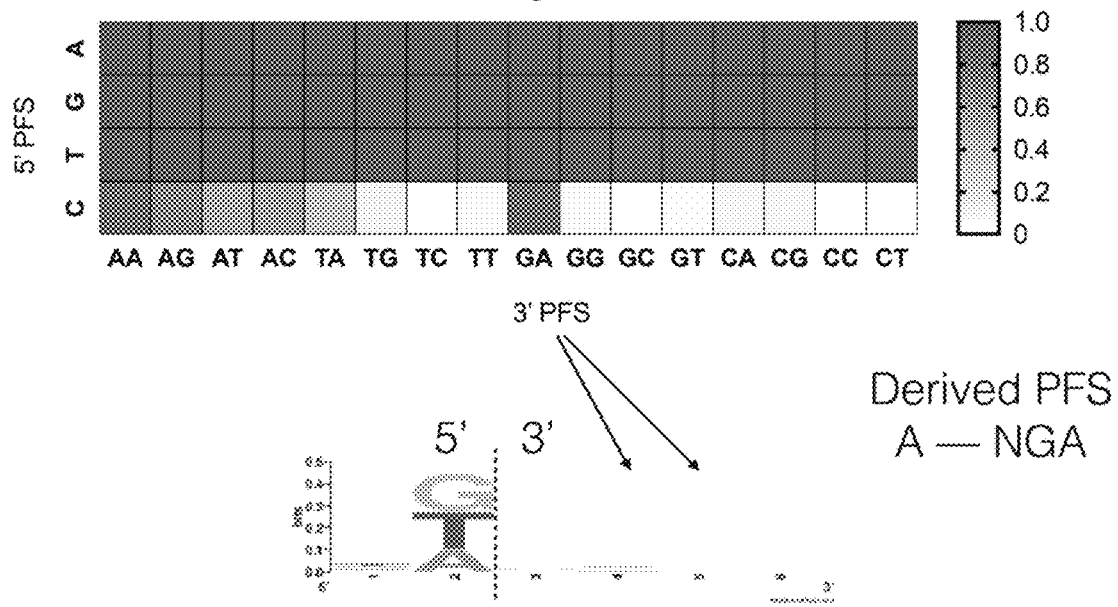
Figure 10E:
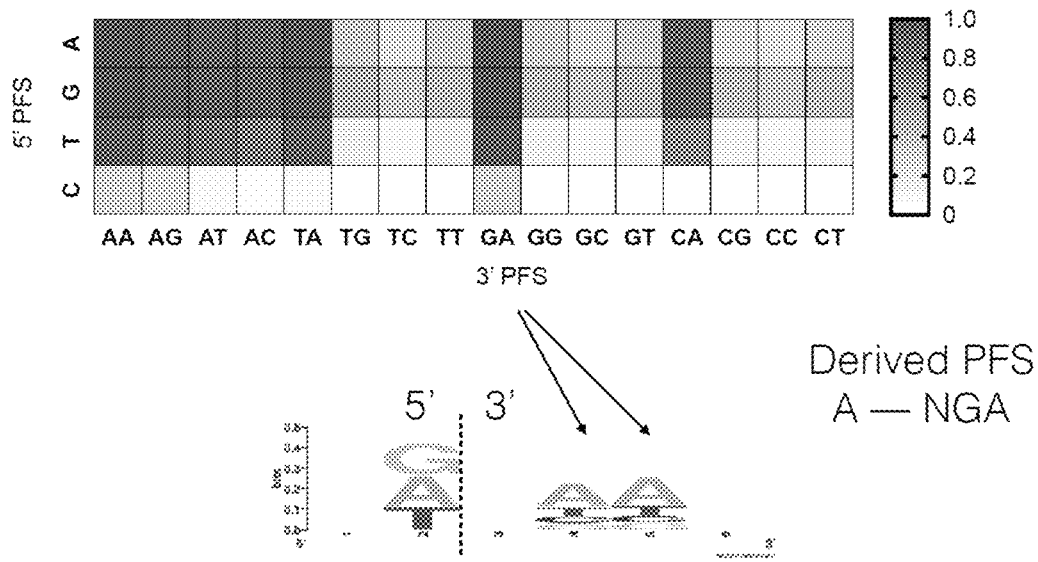
Figure 10F:
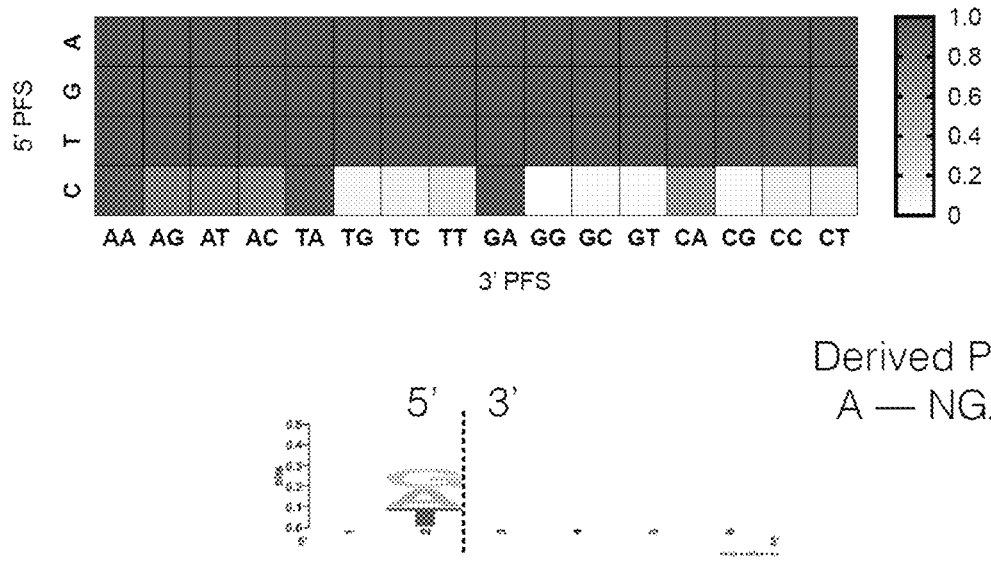
Figure 10G:
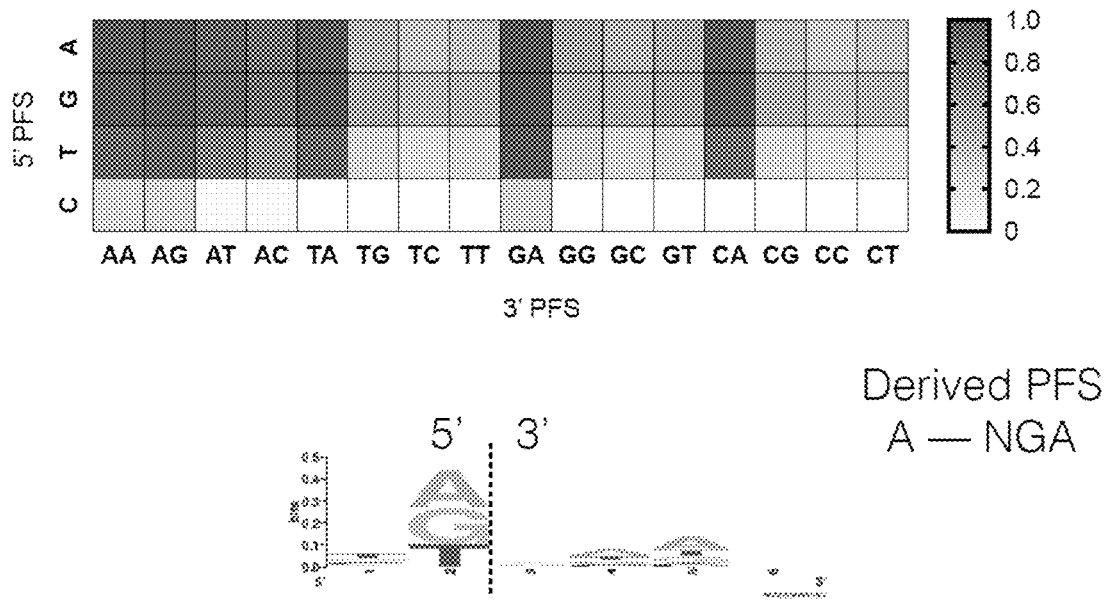
Figure 10H:
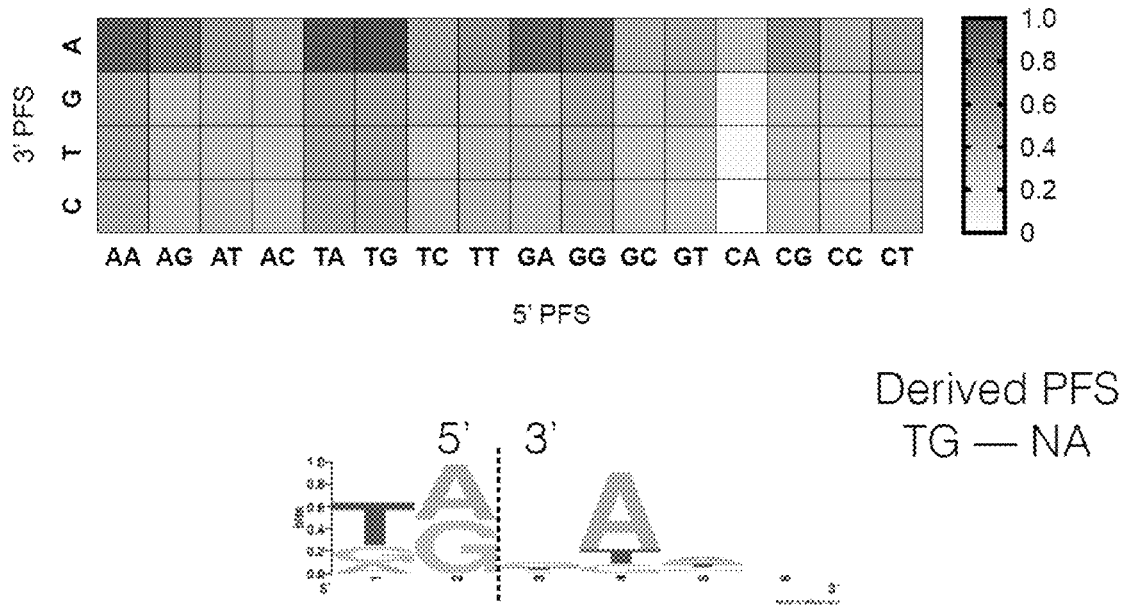
Figure 10I:
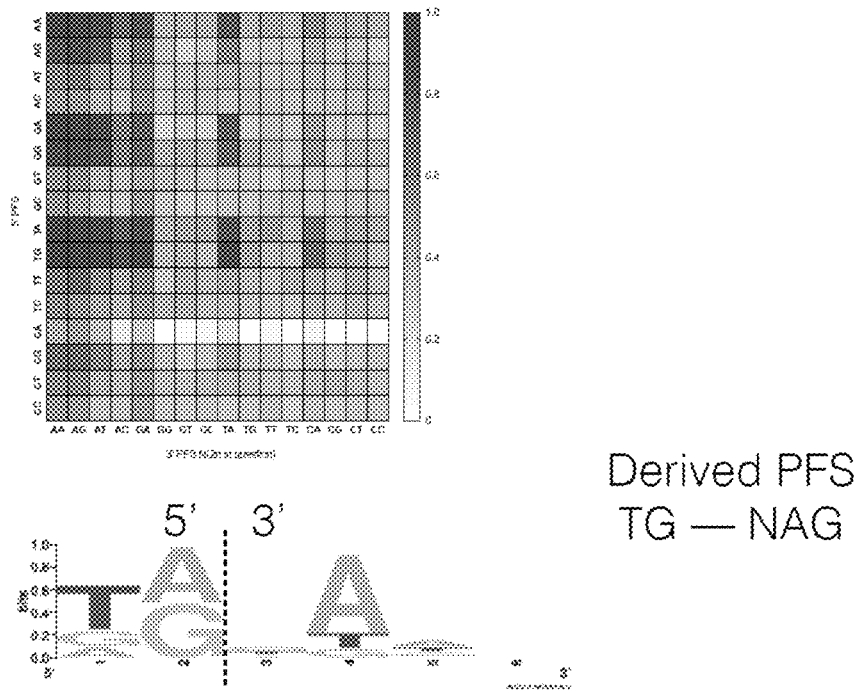
Figure 10J:
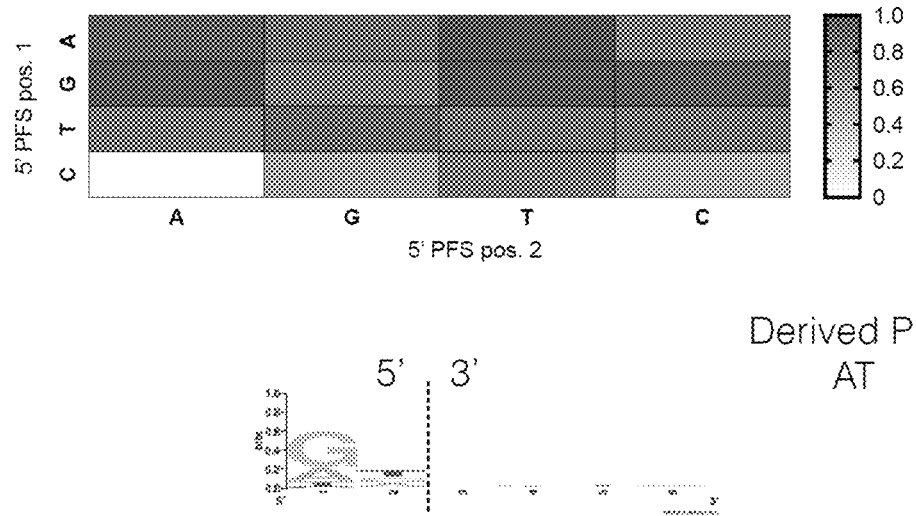
Figure 10K:
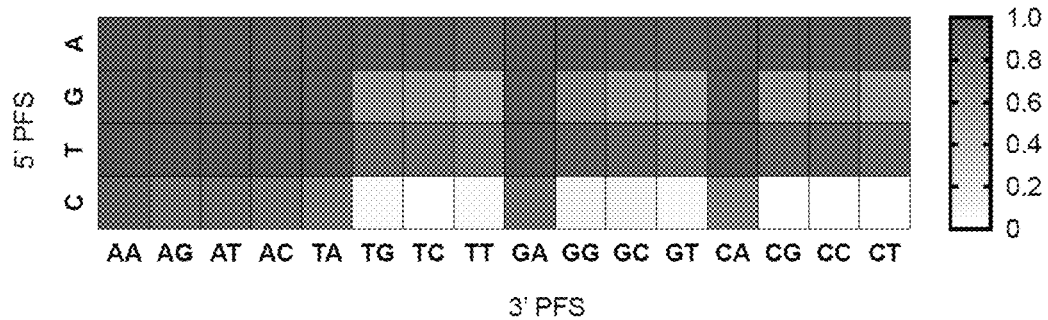
Figure 10K:
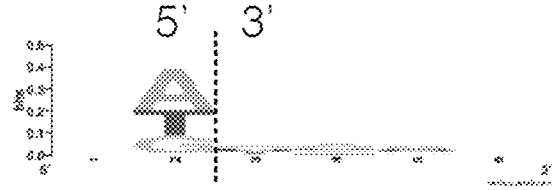
Figure 10L:
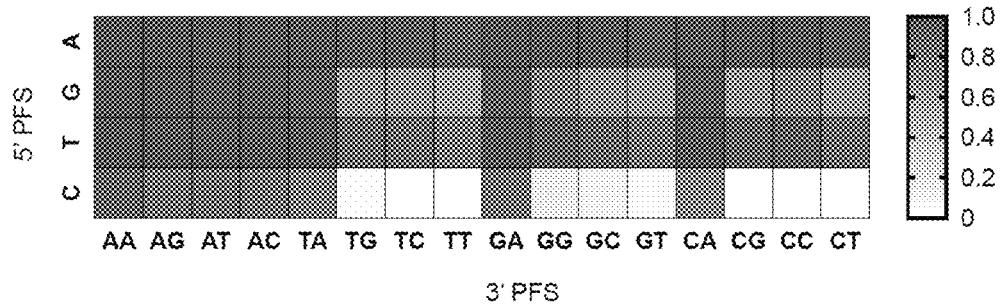
Figure 10L:
Figure 10M:
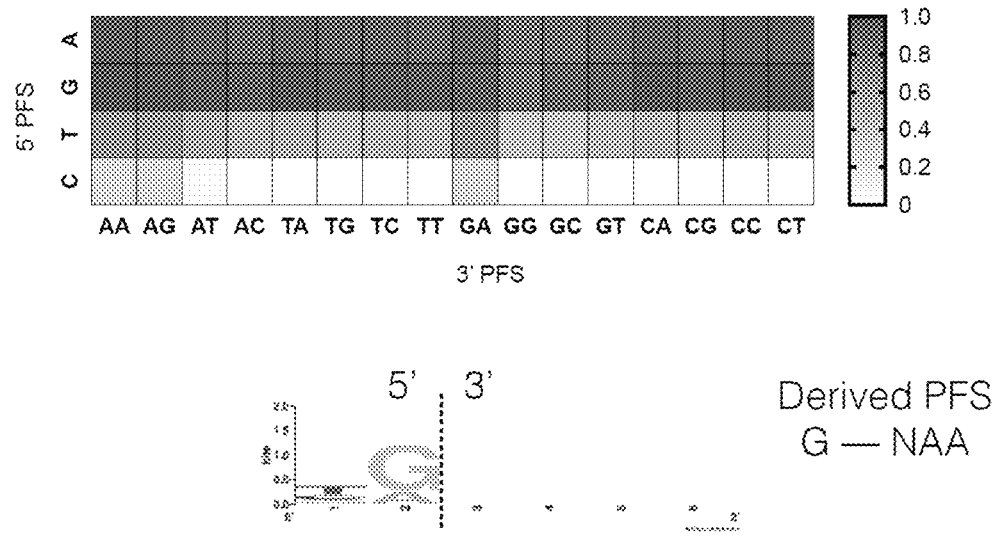
Figure 10N:
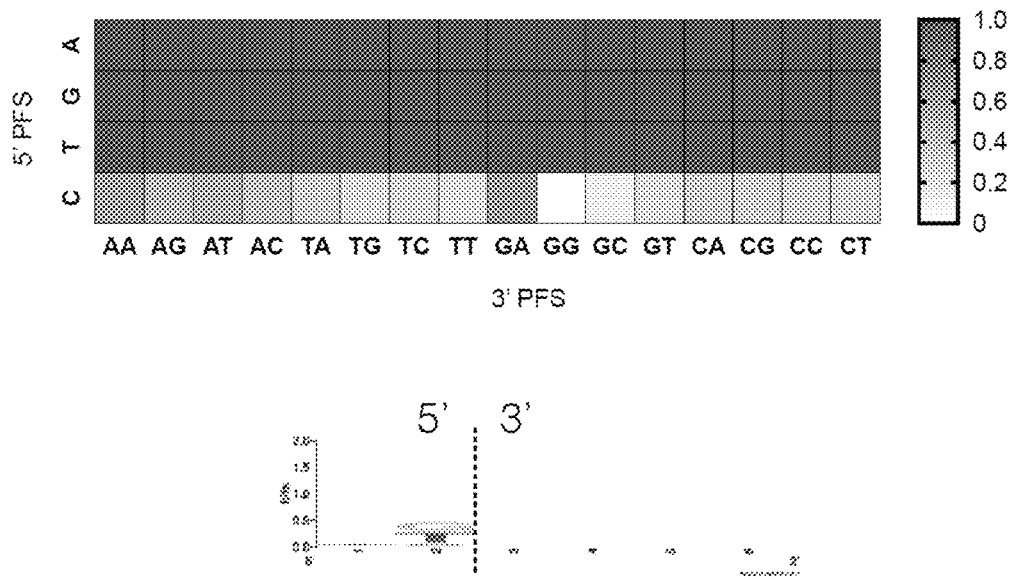
Figure 10O:
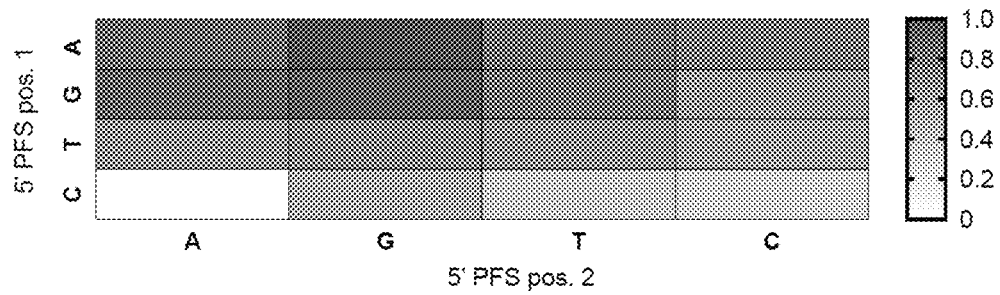
Figure 10O:
Figure 10P:
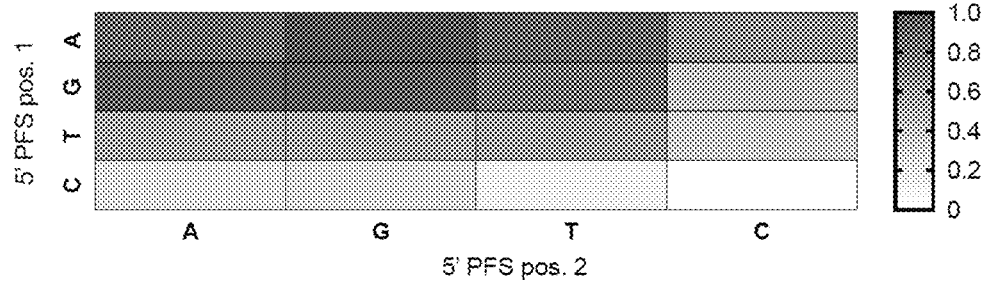
Figure 10P:
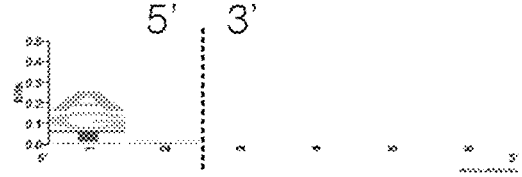
Figure 10Q:
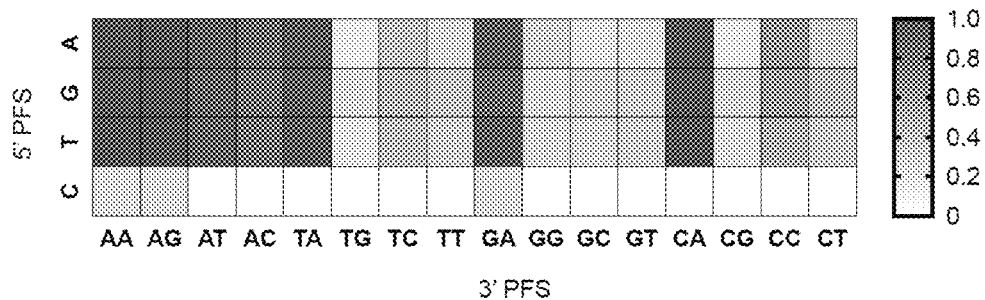
Figure 10Q:
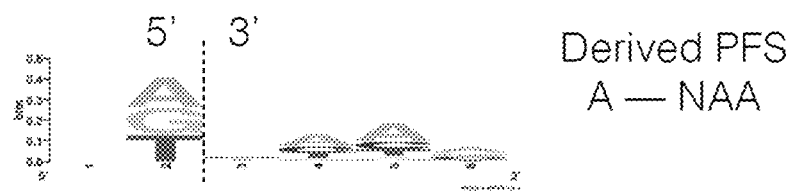
Figure 10R:
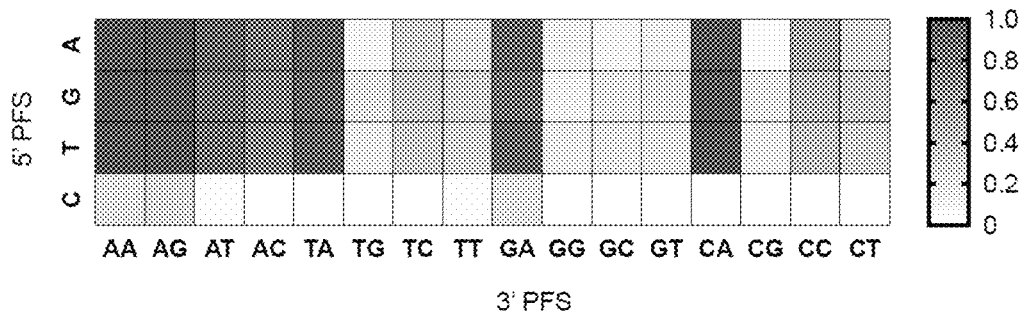
Figure 10R:
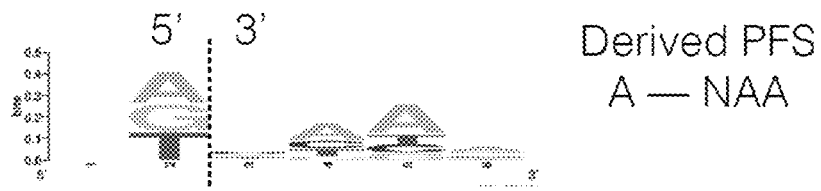
Figure 10S:
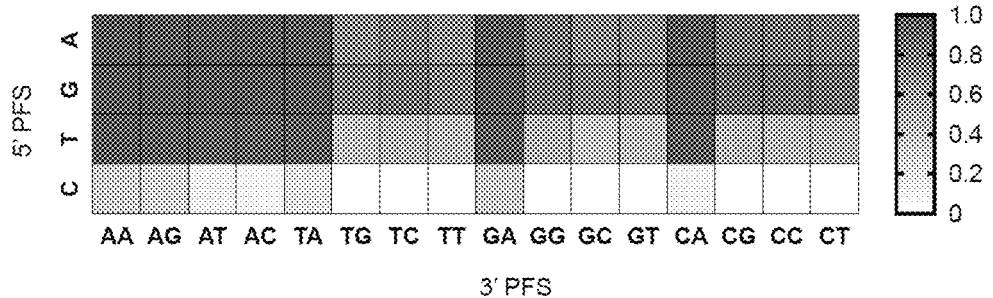
Figure 10S:
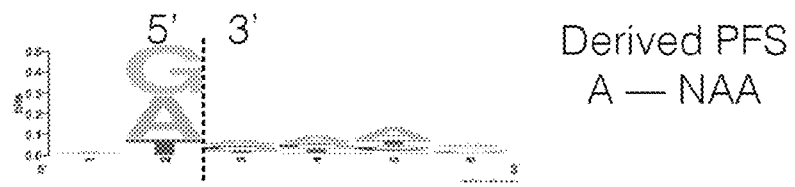
Figure 10T:
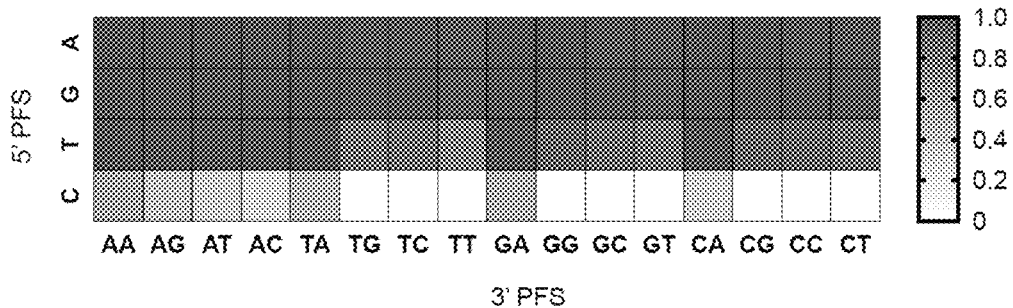
Figure 10T:
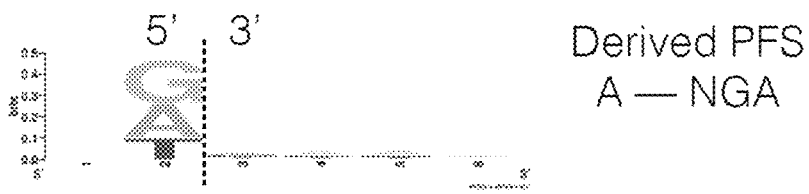
Figure 10U:
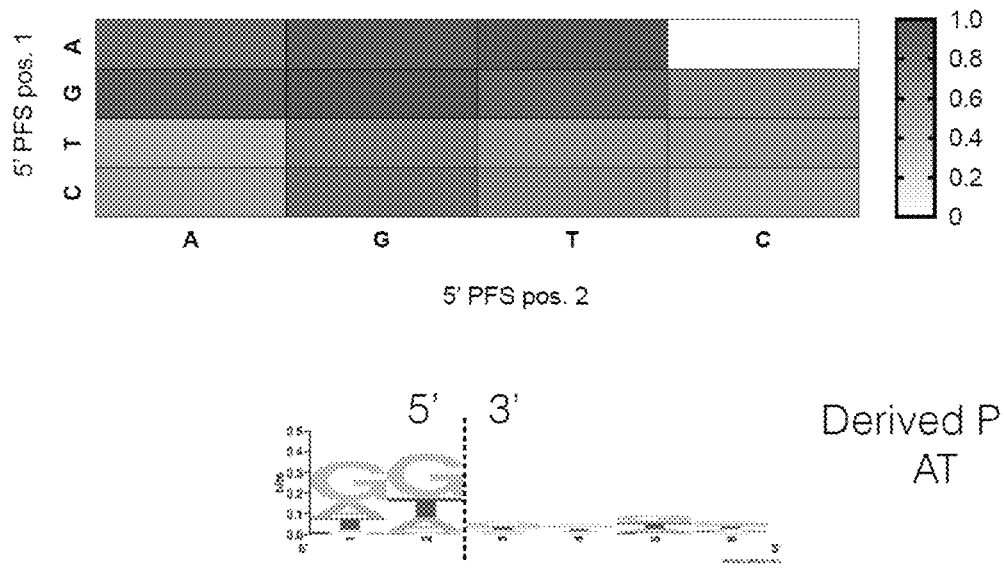
Figure 10V:
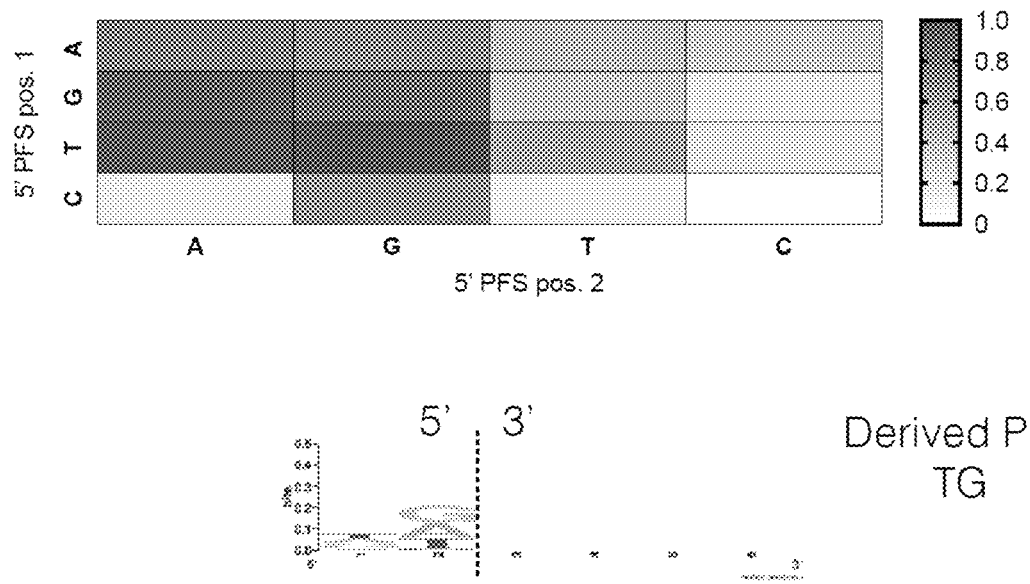
Figure 10W:
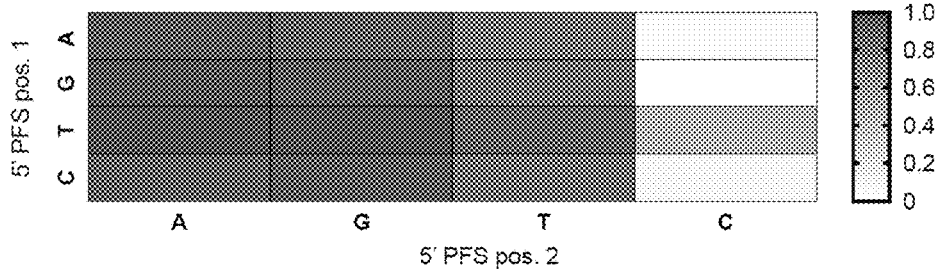
Figure 10X:
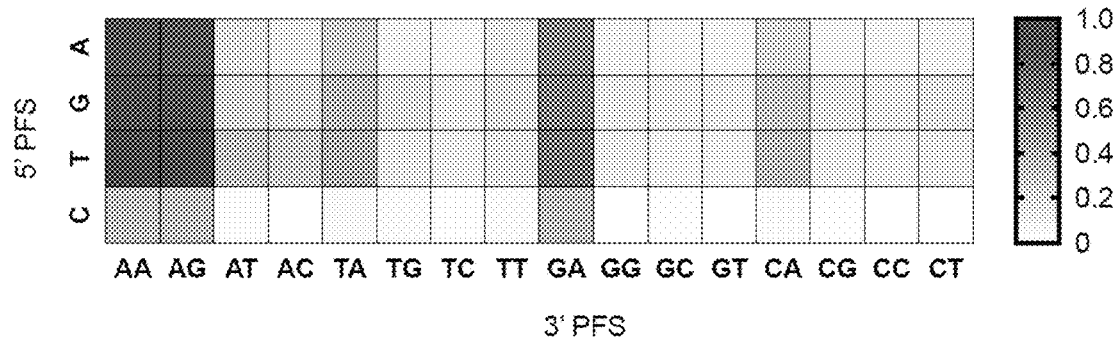
Figure 10Y:
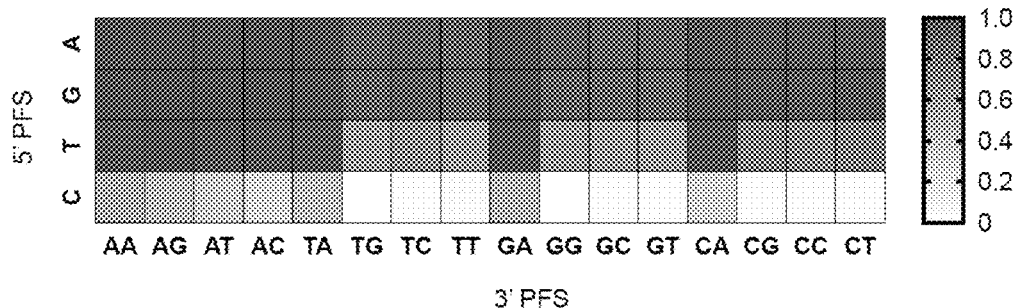
Figure 10Y:
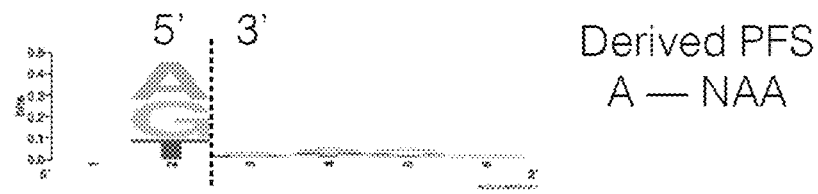
Figure 10Z:
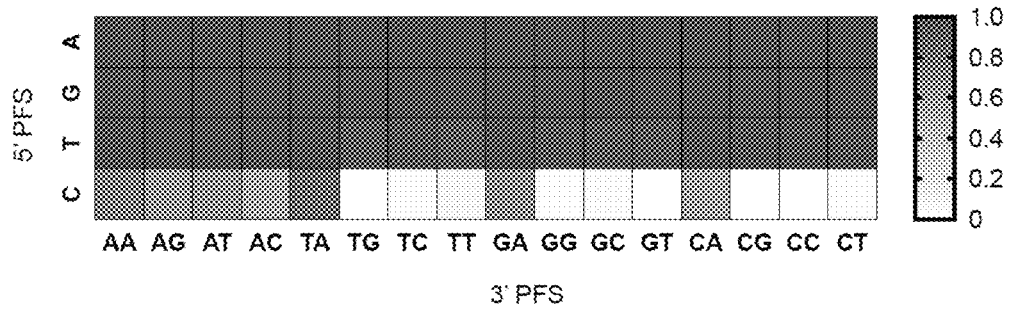
Figure 10Z:
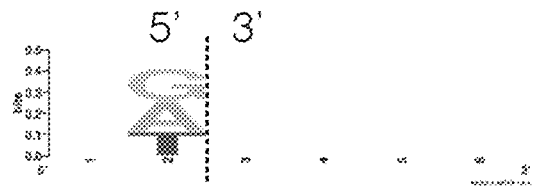
Figure 10A:
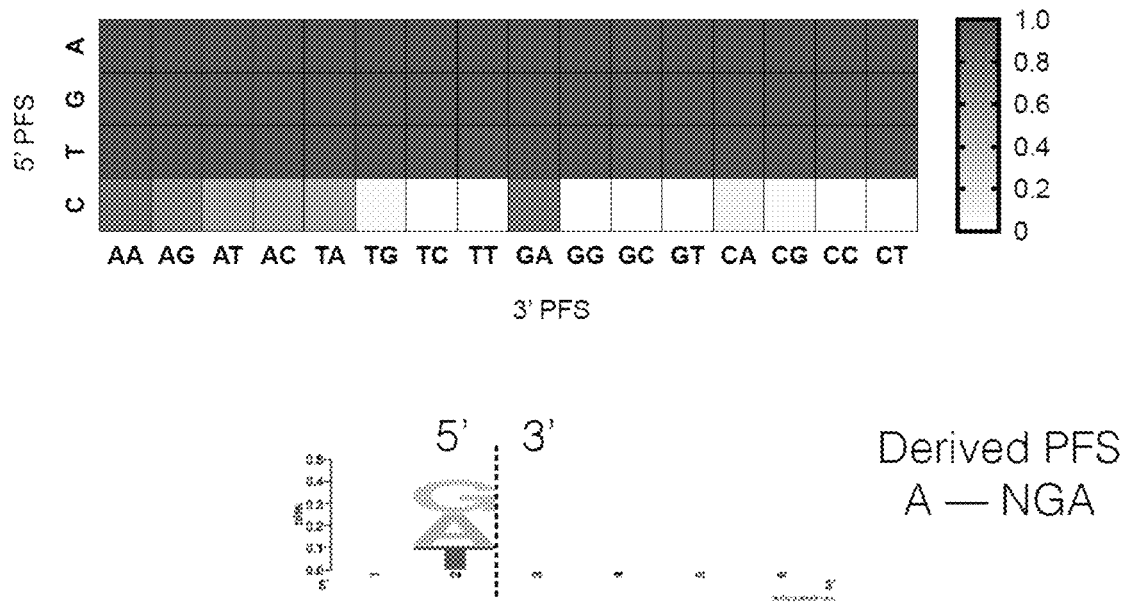
Figure 10B:
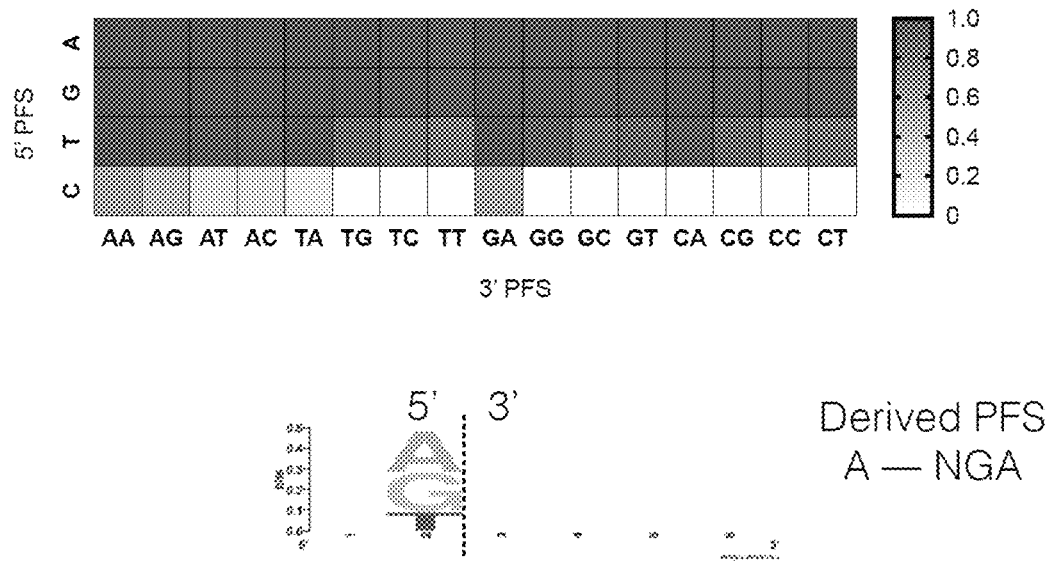
Figure 11:
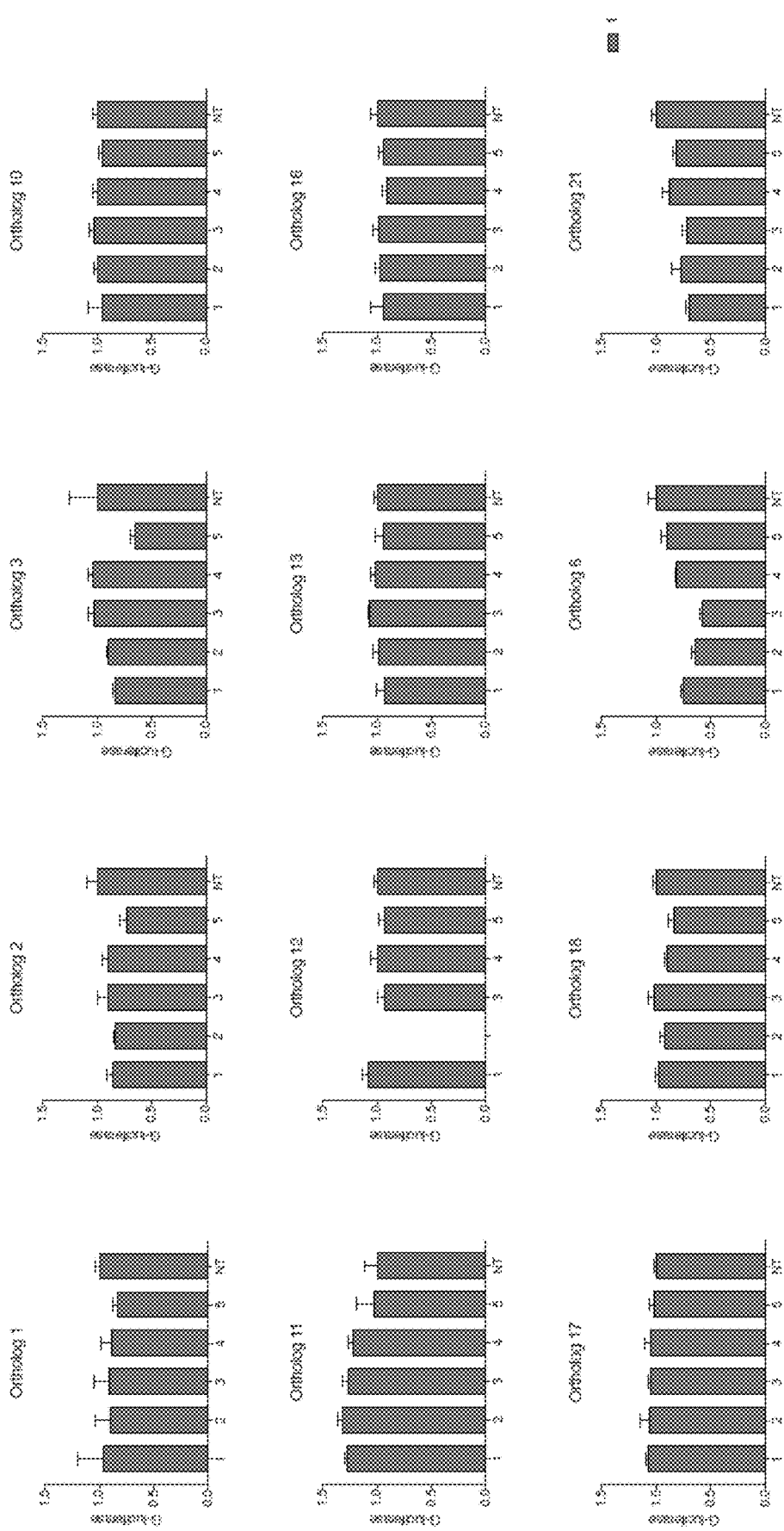
FIG. 11 provides an overview of the luciferase interference data for the Cas13b orthologs that were less active in mammalian cells with the tested guides.
Figure 12:
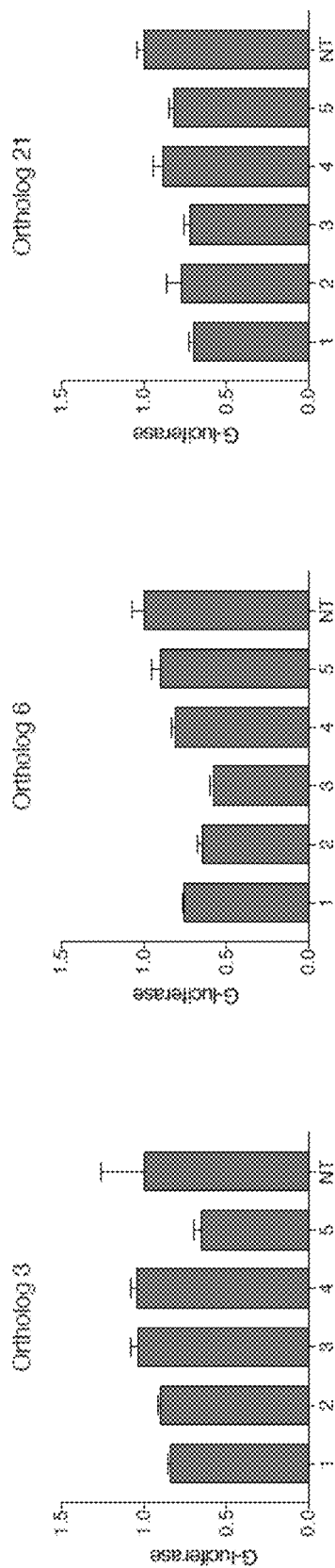
FIG. 12 provides an overview of the luciferase interference data for the Cas13b orthologs that showed low to intermediate activity in mammalian cells with the tested guides.
Figure 13:
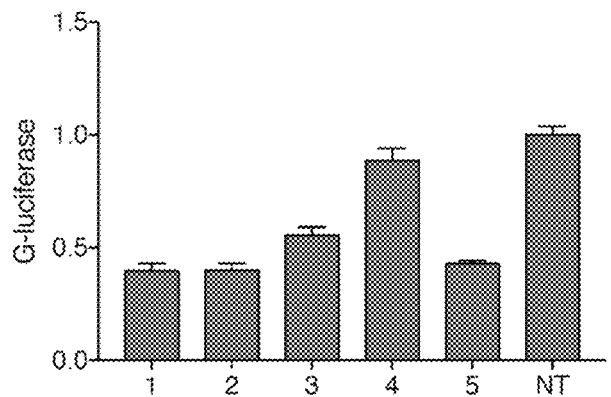
FIG. 13 provides an overview of the luciferase interference data for some of the Cas13b orthologs that showed significant activity in mammalian cells with the tested guides.
Figure 13:
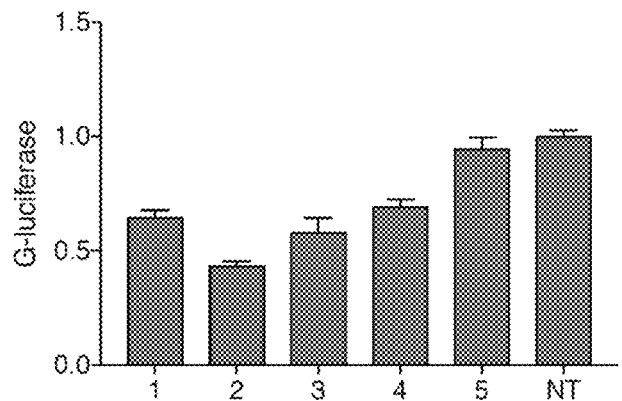
Figure 13:
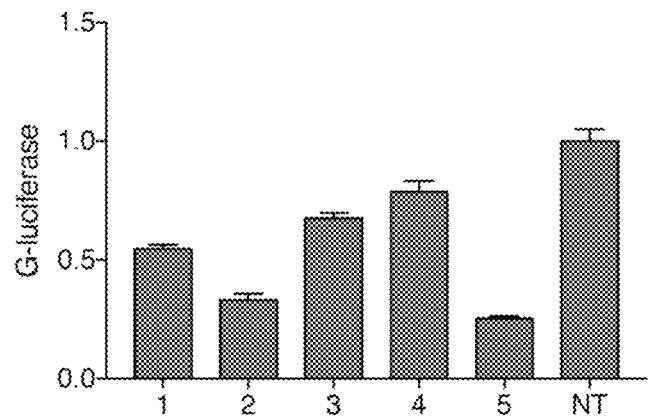
Figure 14A:
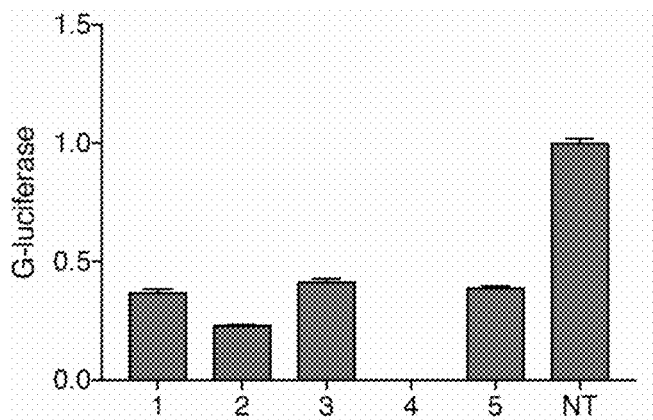
FIG. 14A-14B provides an overview of the luciferase interference data for some of the Cas13b orthologs that showed significant activity in mammalian cells with the tested guides.
Figure 14A:
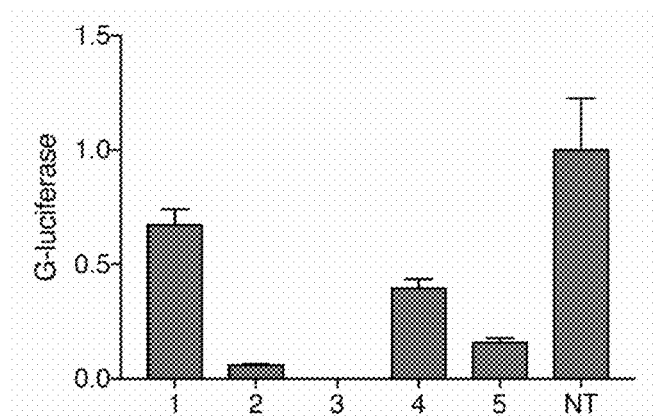
Figure 14A:
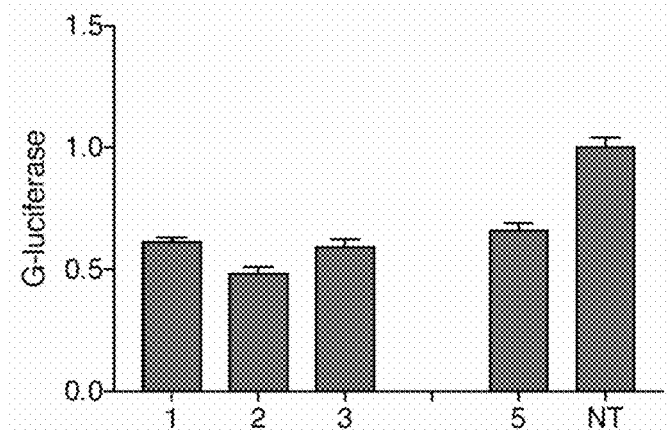
Figure 14B:
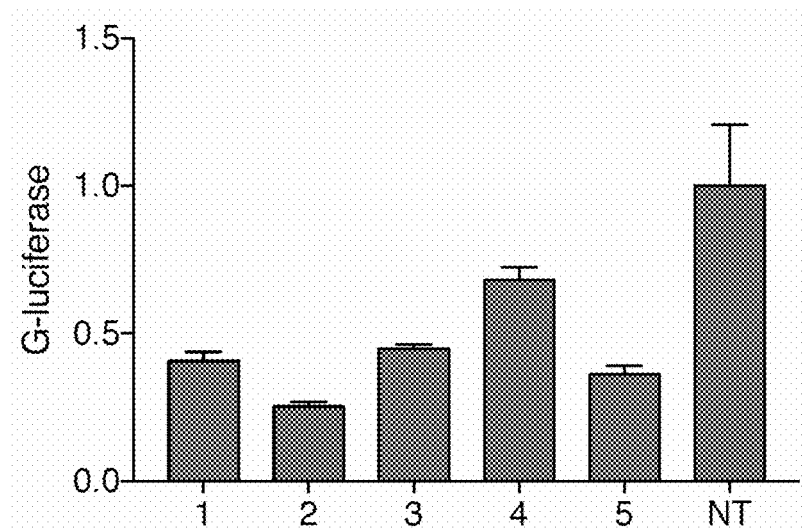
Figure 15:
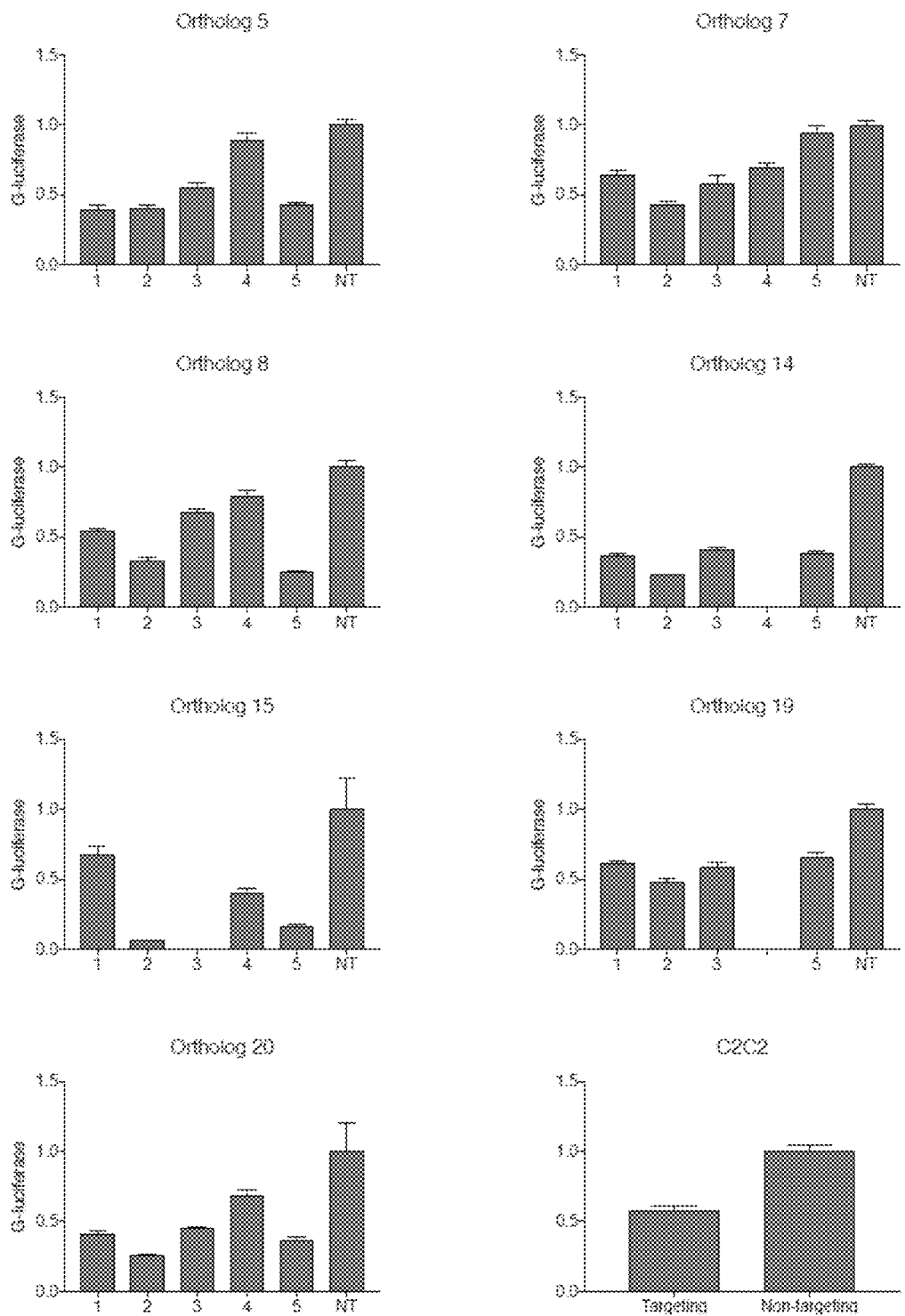
FIG. 15 provides an overview of the luciferase interference data for the Cas13b orthologs that showed significant activity in mammalian cells with the tested guides and comparison with C2c2 activity.

The PFS motif was determined for the different Cas13b orthologs as described in Smargon et al. 2016 and as illustrated in FIG. 6. Heatmaps of the ratio of safely depleted (>5a above mean depletion of non-targeting spacers) spacers to all spacers in the screen were generated. For some orthologs, experiments were repeated in the presence of the accessory protein csx27 or csx28 The results are provided in FIGS. 7-10. The following PFS were derived for the different orthologs:

TABLE 4

| Ortholog | No. | Accessory protein | 5'PFS | 3'PFS |
|---|---|---|---|---|
| Bergeyella zoohelcum | 1 | | A | NGA |
| Bergeyella zoohelcum | 1 | csx27 | A | NGA |
| Prevotella intermedia | 2 | | A | NGA |
| Prevotella intermedia | 2 | csx28 | A | NGA |
| Prevotella buccae | 3 | | A | NGA |
| Prevotella buccae | 3 | csx28 | A | NGA |
| Bacteroides pyogenes | 5 | | A | NGA |
| Alistipes sp. ZOR0009 | 6 | | TG | NA(G) |
| Prevotella sp. MA2016 | 7 | | AT | |
| Riemerella anatipestifer | 8 | | A | NGA |
| Riemerella anatipestifer | 8 | csx28 | A | NGA |
| Prevotella aurantiaca | 9 | | G | NAA |
| Prevotella aurantiaca | 9 | csx28 | | |
| Prevotella saccharolytica | 10 | | AG | |
| Prevotella intermedia | 12 | | AG | |
| Capnocytophaga canimorsus | 13 | | A | NAA |
| Capnocytophaga canimorsus | 13 | csx27 | A | NAA |
| Porphyromonas gulae | 14 | | A | NAA |
| Porphyromonas gulae | 14 | csx28 | A | NGA |
| Prevotella sp. P5-125 | 15 | | AT | |
| Flavobacterium branchiophilum | 16 | | TG | |
| Flavobacterium branchiophilum | 16 | csx27 | TA | |
| Myroides odoratimimus | 17 | | T | NAA |
| Porphyromonas gingivalis | 19 | | A | NAA |
| Porphyromonas gingivalis | 19 | csx28 | A | |
| Prevotella intermedia | 21 | | A | NGA |
| Prevotella intermedia | 21 | csx28 | A | NGA |

Example 4: Collateral Activity of Cas13b Orthologs

In order to determine the collateral activity of Cas13b orthologs in eukaryotic cells, experiments with target specific guides in eukaryotic cells were carried out in the presence of a G-luciferase r C-luciferase reporter construct. The results are provided in FIGS. 17A-G. Collateral activity in vivo was effectively observed for different Cas13b orthologs.

Example 5: Identification of Further Cas13b Orthologs

Further Cas13b orthologs can be identified using a bio-computational pipeline relying on either proximity to CRISPR associated proteins or CRISPR arrays per se. An exemplary method may include downloading of all prokaryotic genomes (from the NCBI database), running an algorithm on these genomes to identify CRISPR arrays, storing proteins clustered within 10 kb of the identified array as putative CRISPR systems and further selecting candidate systems based on the absence of proteins greater than 700 amino acids in size. Further selection criteria can be based on the presence of only one effector protein between 900-1800 amino acids in size and based on functionality and compatibility considerations.

Example 6

Efficient and precise nucleic acid editing holds great promise for treating genetic disease, particularly at the level of RNA, where disease-relevant transcripts can be rescued to yield functional protein products. Type VI CRISPR-Cas systems contain the programmable single-effector RNA-guided RNases Cas13. Here, we profile the diversity of Type VI systems to engineer a Cas13 ortholog capable of robust knockdown and demonstrate RNA editing by using catalytically-inactive Cas13 (dCas13) to direct adenosine deaminase activity to transcripts in mammalian cells. By fusing the ADAR2 deaminase domain to dCas13 and engineering guide RNAs to create an optimal RNA duplex substrate, we achieve targeted editing of specific single adenosines to inosines (which is read out as guanosine during translation) with efficiencies routinely ranging from 20-40% and up to 89%. This system, referred to as RNA Editing for Programmable A to I Replacement (REPAIR), can be further engineered to achieve high specificity. An engineered variant, REPAIRv2, displays greater than 170-fold increase in specificity while maintaining robust on-target A to I editing. We use REPAIRv2 to edit full-length transcripts containing known pathogenic mutations and create functional truncated versions suitable for packaging in adeno-associated viral (AAV) vectors. REPAIR presents a promising RNA editing platform with broad applicability for research, therapeutics, and biotechnology. Precise nucleic acid editing technologies are valuable for studying cellular function and as novel therapeutics. Although current editing tools, such as the Cas9 nuclease, can achieve programmable modification of genomic loci, edits are often heterogenous due to insertions or deletions or require a donor template for precise editing. Base editors, such as dCas9-APOBEC fusions, allow for editing without generating a double stranded break, but may lack precision due to the nature of cytidine deaminase activity, which edits any cytidine in a target window. Furthermore, the requirement for a protospacer adjacent motif (PAM) limits the number of possible editing sites. Here, we describe the development of a precise and flexible RNA base editing tool using the RNA-guided RNA targeting Cas13 enzyme from type VI prokaryotic clustered regularly interspaced short palindromic repeats (CRISPR) adaptive immune system.

Precise nucleic acid editing technologies are valuable for studying cellular function and as novel therapeutics. Current editing tools, based on programmable nucleases such as the prokaryotic clustered regularly interspaced short palindromic repeats (CRISPR)-associated nucleases Cas9 (1-4) or Cpf1(5), have been widely adopted for mediating targeted DNA cleavage which in turn drives targeted gene disruption through non-homologous end joining (NHEJ) or precise gene editing through template-dependent homology-directed repair (HDR)(6). NHEJ utilizes host machineries that are active in both dividing and post-mitotic cells and provides efficient gene disruption by generating a mixture of insertion or deletion (indel) mutations that can lead to frame shifts in protein coding genes. HDR, in contrast, is mediated by host machineries whose expression is largely limited to replicating cells. As such, the development of gene-editing capabilities in post-mitotic cells remains a major challenge. Recently, DNA base editors, such as the use of catalytically inactive Cas9 (dCas9) to target cytidine deaminase activity to specific genome targets to effect cytosine to thymine conversions within a target window, allow for editing without generating a DNA double strand break and significantly reduces the formation of indels(7, 8). However the targeting range of DNA base editors is limited due to the requirement of Cas9 for a protospacer adjacent motif (PAM) at the editing site(9). Here, we describe the development of a precise and flexible RNA base editing technology using the type VI CRISPR-associated RNA-guided RNase Cas13(10-13).

Cas13 enzymes have two Higher Eukaryotes and Prokaryotes Nucleotide-binding (HEPN) endoRNase domains that mediate precise RNA cleavage(10, 11). Three Cas13 protein families have been identified to date: Cas13a (previously known as C2c2), Cas13b, and Cas13c(12, 13). We recently reported Cas13a enzymes can be adapted as tools for nucleic acid detection(14) as well as mammalian and plant cell RNA knockdown and transcript tracking(15). The RNA-guided nature of Cas13 enzymes makes them attractive tool for RNA binding and perturbation applications.

The adenosine deaminase acting on RNA (ADAR) family of enzymes mediates endogenous editing of transcripts via hydrolytic deamination of adenosine to inosine, a nucleobase that is functionally equivalent to guanosine in translation and splicing(16). There are two functional human ADAR orthologs, ADAR1 and ADAR2, which consist of N-terminal double stranded RNA-binding domains and a C-terminal catalytic deamination domain. Endogenous target sites of ADAR1 and ADAR2 contain substantial double stranded identity, and the catalytic domains require duplexed regions for efficient editing in vitro and in vivo(17, 18). Although ADAR proteins have preferred motifs for editing that could restrict the potential flexibility of targeting, hyperactive mutants, such as ADAR(E488Q)(19), relax sequence constraints and improve adenosine to inosine editing rates. ADARs preferentially deaminate adenosines opposite cytidine bases in RNA duplexes(20), providing a promising opportunity for precise base editing. Although previous approaches have engineered targeted ADAR fusions via RNA guides (21-24), the specificity of these approaches has not been reported and their respective targeting mechanisms rely on RNA-RNA hybridization without the assistance of protein partners that may enhance target recognition and stringency.

Here we assay the entire family of Cas13 enzymes for RNA knockdown activity in mammalian cells and identify the Cas13b ortholog from *Prevotella* sp. P5-125 (PspCas13b) as the most efficient and specific for mammalian cell applications. We then fuse the ADAR2 deaminase domain (ADARDD) to catalytically inactive PspCas13b and demonstrate RNA editing for programmable A to I (G) replacement (REPAIR) of reporter and endogenous transcripts as well as disease-relevant mutations. Lastly, we employ a rational mutagenesis scheme to improve the specificity of dCas13b-ADAR2DD fusions to generate REPAIRv2 with more than 170 fold increase in specificity.

Methods

Design and Cloning of Bacterial Constructs

Mammalian codon optimized Cas13b constructs were cloned into the chloramphenicol resistant pACYC184 vector under control of the Lac promoter. Two corresponding direct-repeat (DR) sequences separated by BsaI restriction sites were then inserted downstream of Cas13b, under control of the pJ23119 promoter. Last, oligos for targeting spacers were phosphorylated using T4 PNK (New England Biolabs), annealed and ligated into BsaI digested vectors using T7 ligase (Enzymatics) to generate targeting Cas13b vectors.

Bacterial PFS Screens

Ampicillin resistance plasmids for PFS screens were cloned by inserting PCR products containing Cas13b targets with 2 5' randomized nucleotides and 4 3' randomized nucleotides separated by a target site immediately downstream of the start codon of the ampicillin resistance gene bla using NEB Gibson Assembly (New England Biolabs). 100 ng of ampicillin-resistant target plasmids were then electroporated with 65-100 ng chloramphenicol-resistant Cas13b bacterial targeting plasmids into Endura Electrocompetent Cells. Plasmids were added to cells, incubated 15 minutes on ice, electroporated using the manufacturer's protocol, and then 950 uL of recovery media was added to cells before a one hour outgrowth at 37 C. The outgrowth was plated onto chloramphenicol and ampicillin double selection plates. Serial dilutions of the outgrowth were used to estimate the cfu/ng DNA. 16 hours post plating, cells were scraped off plates and surviving plasmid DNA harvested using the Qiagen Plasmid Plus Maxi Kit (Qiagen). Surviving Cas13b target sequences and their flanking regions were amplified by PCR and sequenced using an Illumina NextSeq. To assess PFS preferences, the positions containing randomized nucleotides in the original library were extracted, and sequences depleted relative to the vector only condition that were present in both bioreplicates were extracted using custom python scripts. The –log 2 of the ratio of PFS abundance in the Cas13b condition compared to the vector only control was then used to calculate preferred motifs. Specifically, all sequences having –log 2 (sample/vector) depletion ratios above a specific threshold were used to generate weblogos of sequence motifs (weblogo.berkeley.edu). The specific depletion ratio values used to generate weblogos for each Cas13b ortholog are listed in Table 9.

Design and Cloning of Mammalian Constructs for RNA Interference

To generate vectors for testing Cas13 orthologs in mammalian cells, mammalian codon optimized Cas13a, Cas13b, and Cas13c genes were PCR amplified and golden-gate cloned into a mammalian expression vector containing dual NLS sequences and a C-terminal msfGFP, under control of the EF1alpha promoter. For further optimization Cas13 orthologs were golden gate cloned into destination vectors containing different C-terminal localization tags under control of the EF1alpha promoter.

The dual luciferase reporter was cloned by PCR amplifying Gaussia and Cypridina luciferase coding DNA, the EF1alpha and CMV promoters and assembly using the NEB Gibson Assembly (New England Biolabs).

For expression of mammalian guide RNA for Cas13a, Cas13b, or Cas13c orthologs, the corresponding direct repeat sequences were synthesized with golden-gate acceptor sites and cloned under U6 expression via restriction digest cloning. Individual guides were then cloned into the corresponding expression backbones for each ortholog by golden gate cloning.

Cloning of Pooled Mismatch Libraries for Cas13 Interference Specificity

Pooled mismatch library target sites were created by PCR. Oligos containing semi-degenerate target sequences in G-luciferase containing a mixture of 94% of the correct base and 2% of each incorrect base at each position within the target were used as one primer, and an oligo corresponding to a non-targeted region of G-luciferase was used as the second primer in the PCR reaction. The mismatch library target was then cloned into the dual luciferase reporter in place of the wildtype G-luciferase using NEB Gibson assembly (New England Biolabs).

Design and Cloning of Mammalian Constructs for RNA Editing

PspCas13b was made catalytically inactive (dPspCas13b) via two histidine to alanine mutations (H133A/H1058A) at the catalytic site of the HEPN domains. The deaminase domains of human ADAR1 and ADAR2 were synthesized and PCR amplified for gibson cloning into pcDNA-CMV vector backbones and were fused to dPspCas13b at the C-terminus via GS or GSGGGGS linkers. For the experiment in which we tested different linkers we cloned the following additional linkers between dPspCas13b and ADAR2dd: GGGGSGGGGSGGGGS (SEQ ID NO: 152), EAAAK, GGSGGSGGSGGSGGSGGS (SEQ ID NO: 153), and SGSETPGTSESATPES (XTEN) (SEQ ID NO: 154). Specificity mutants were generated by gibson cloning the appropriate mutants into the dPspCas13b-GSGGGGS backbone.

The luciferase reporter vector for measuring RNA editing activity was generated by creating a W85X mutation (TGG>TAG) in the luciferase reporter vector used for knockdown experiments. This reporter vector expresses functional Gluc as a normalization control, but a defective Cluc due to the addition of a pretermination site. To test ADAR editing motif preferences, we cloned every possible motif around the adenosine at codon 85 (XAX) of Cluc.

For testing PFS preference of REPAIR, we cloned a pooled plasmid library containing a 6 basepair degenerate PFS sequence upstream of a target region and adenosine editing site. The library was synthesized as an ultramer from Integrated DNA Technologies (IDT) and was made double stranded via annealing a primer and Klenow fragment of DNA polymerase I (New England Biolabs) fill in of the sequence. This dsDNA fragment containing the degenerate sequence was then gibson cloned into the digested reporter vector and this was then isopropanol precipitated and purified. The cloned library was then electroporated into Endura competent *E. coli* cells (Lucigen) and plated on 245 mm×245 mm square bioassay plates (Nunc). After 16 hours, colonies were harvested and midi-prepped using endotoxin-free MACHEREY-NAGEL midi-prepp kits. Cloned libraries were verified by next generation sequencing.

For cloning disease-relevant mutations for testing REPAIR activity, 34 G>A mutations related to disease pathogenesis as defined in ClinVar were selected and 200 bp regions surrounding these mutations were golden gate cloned between mScarlett and EGFP under a CMV promoter. Two additional G>A mutations in AVPR2 and FANCC were selected for Gibson cloning the whole gene sequence under expression of EF1alpha.

For expression of mammalian guide RNA for REPAIR, the PspCas13b direct repeat sequences were synthesized with golden-gate acceptor sites and cloned under U6 expression via restriction digest cloning. Individual guides were then cloned into this expression backbones by golden gate cloning.

Mammalian Cell Culture

Mammalian cell culture experiments were performed in the HEK293FT line (American Type Culture Collection (ATCC)), which was grown in Dulbecco's Modified Eagle Medium with high glucose, sodium pyruvate, and Gluta-MAX (Thermo Fisher Scientific), additionally supplemented with 1× penicillin-streptomycin (Thermo Fisher Scientific) and 10% fetal bovine serum (VWR Seradigm). Cells were maintained at confluency below 80%.

Unless otherwise noted, all transfections were performed with Lipofectamine 2000 (Thermo Fisher Scientific) in 96-well plates coated with poly-D-lysine (BD Biocoat). Cells were plated at approximately 20,000 cells/well sixteen hours prior to transfection to ensure 90% confluency at the time of transfection. For each well on the plate, transfection plasmids were combined with Opti-MEM I Reduced Serum Medium (Thermo Fisher) to a total of 25 µl. Separately, 24.5 ul of Opti-MEM was combined with 0.5 ul of Lipofectamine 2000. Plasmid and Lipofectamine solutions were then combined and incubated for 5 minutes, after which they were pipetted onto cells.

RNA Knockdown Mammalian Cell Assays

To assess RNA targeting in mammalian cells with reporter constructs, 150 ng of Cas13 construct was co-transfected with 300 ng of guide expression plasmid and 12.5 ng of the knockdown reporter construct. 48 hours post-transfection, media containing secreted luciferase was removed from cells, diluted 1:5 in PBS, and measured for activity with BioLux Cypridina and Biolux Gaussia luciferase assay kits (New England Biolabs) on a plate reader (Biotek Synergy Neo2) with an injection protocol. All replicates performed are biological replicates.

For targeting of endogenous genes, 150 ng of Cas13 construct was co-transfected with 300 ng of guide expression plasmid. 48 hours post-transfection, cells were lysed and RNA was harvested and reverse transcribed using a previously described [CITE PROTOCOLS] modification of the Cells-to-Ct kit (Thermo Fisher Scientific). cDNA expression was measured via qPCR using TaqMan qPCR probes for the KRAS transcript (Thermo Fisher Scientific), GAPDH control probes (Thermo Fisher Scientific), and Fast Advanced Master Mix (Thermo Fisher Scientific). qPCR reactions were read out on a LightCycler 480 Instrument II (Roche), with four 5 ul technical replicates in 384-well format.

Evaluation of RNA Specificity Using Pooled Library of Mismatched Targets

The ability of Cas13 to interfere with the mismatched target library was tested using HEK293FT cells seeded in 6 well plates. ~70% confluent cells were transfected using 2400 ng Cas13 vector, 4800 ng of guide and 240 ng of mismatched target library. 48 hours post transfection, cells were harvested and RNA extracted using the QIAshredder (Qiagen) and the Qiagen RNeasy Mini Kit. 1ug of extracted RNA was reverse transcribed using the qScript Flex cDNA synthesis kit (Quantabio) following the manufacturer's gene-specific priming protocol and a Gluc specific RT primer. cDNA was then amplified and sequenced on an Illumina NextSeq.

The sequencing was analyzed by counting reads per sequence and depletion scores were calculated by determining the log 2(−read count ratio) value, where read count ratio is the ratio of read counts in the targeting guide condition versus the non-targeting guide condition. This score value represents the level of Cas13 activity on the sequence, with higher values representing stronger depletion and thus higher Cas13 cleavage activity. Separate distributions for the single mismatch and double mismatch sequences were determined and plotted as heatmaps with a depletion score for each mismatch identity. For double mismatch sequences the average of all possible double mismatches at a given position were plotted.

Transcriptome-Wide Profiling of Cas13 in Mammalian Cells by RNA Sequencing

For measurement of transcriptome-wide specificity, 150 ng of Cas13 construct, 300 ng of guide expression plasmid and 15 ng of the knockdown reporter construct were co-transfected; for shRNA conditions, 300 ng of shRNA targeting plasmid, 15 ng of the knockdown reporter construct, and 150 ng of EF1-alpha driven mCherry (to balance reporter load) were co-transfected. 48 hours after transfection, RNA was purified with the RNeasy Plus Mini kit (Qiagen), mRNA was selected for using NEBNext Poly(A) mRNA Magnetic Isolation Module (New England Biolabs) and prepared for sequencing with the NEBNext Ultra RNA Library Prep Kit for Illumina (New England Biolabs). RNA sequencing libraries were then sequenced on a NextSeq (Illumina).

To analyze transcriptome-wide sequencing data, reads were aligned RefSeq GRCh38 assembly using Bowtie and RSEM version 1.2.31 with default parameters [CITE RSEM: accurate transcript quantification from RNA-Seq data with or without a reference genome]. Transcript expression was quantified as log 2(TPM+1), genes were filtered for log 2(TPM+1)>2.5 For selection of differentially expressed genes, only genes with differential changes of >2 or <0.75 were considered. Statistical significance of differential expression was evaluated Student's T-test on three targeting replicates versus non-targeting replicates, and filtered for a false discovery rate of <0.01% by Benj amini-Hochb erg procedure.

ADAR RNA Editing in Mammalian Cells Transfections

To assess REPAIR activity in mammalian cells, we transfected 150 ng of REPAIR vector, 300 ng of guide expression plasmid, and 40 ng of the RNA editing reporter. After 48 hours, RNA from cells were harvested and reverse transcribed using a method previously described [cite JJ] with a gene specific reverse transcription primer. The extracted cDNA was then subjected to two rounds of PCR to add Illumina adaptors and sample barcodes using NEBNext High-Fidelity 2×PCR Master Mix. The library was then subjected to next generation sequencing on an Illumina NextSeq or MiSeq. RNA editing rates were then evaluated at all adenosines within the sequencing window.

In experiments where the luciferase reporter was targeted for RNA editing, we also harvested the media with secreted luciferase prior to RNA harvest. In this case, because the corrected Cluc might be at low levels, we did not dilute the media. We measured luciferase activity with BioLux *Cypridina* and Biolux *Gaussia* luciferase assay kits (New England Biolabs) on a plate reader (Biotek Synergy Neo2) with an injection protocol. All replicates performed are biological replicates.

PFS Binding Mammalian Screen

To determine the contribution of the PFS to editing efficiency, 625 ng of PFS target library, 4.7 ug of guide, and 2.35 ug of REPAIR were co-transfected on HEK293FT cells plated in 225 cm2 flasks. Plasmids were mixed with 33 ul of PLUS reagent (Thermo Fisher Scientific), brought to 533 ul with Opti-MEM, incubated for 5 minutes, combined with 30 ul of Lipofectamine 2000 and 500 ul of Opti-MEM, incubated for an additional 5 minutes, and then pipetted onto cells. 48 hours post-transfection, RNA was harvested with the RNeasy Plus Mini kit (Qiagen), reverse transcribed with qScript Flex (Quantabio) using a gene specific primer, and amplified with two rounds of PCR using NEBNext High-Fidelity 2×PCR Master Mix (New England Biolabs) to add Illumina adaptors and sample barcodes. The library was sequenced on an Illumina NextSeq, and RNA editing rates at the target adenosine were mapped to PFS identity. To increase coverage, the PFS was computationally collapsed to 4 nucleotides. REPAIR editing rates were calculated for each PFS, averaged over biological replicates with non-targeting rates for the corresponding PFS subtracted.

Whole-Transcriptome Sequencing to Evaluate ADAR Editing Specificity

For analyzing off-target RNA editing sites across the transcriptome, we harvested total RNA from cells 48 hours post transfection using the RNeasy Plus Miniprep kit (Qiagen). The mRNA fraction is then enriched using a NEBNext Poly(A) mRNA Magnetic Isolation Module (NEB) and this RNA is then prepared for sequencing using NEBNext Ultra RNA Library Prep Kit for Illumina (NEB). The libraries were then sequenced on an Illumina NextSeq and loaded such that there was at least 5 million reads per sample.

RNA Editing Analysis for Targeted and Transcriptome Wide Experiments

To analyze the transcriptome-wide RNA editing RNA sequencing data, sequence files were randomly down-sampled to 5 million reads. An index was generated using the RefSeq GRCh38 assembly with Gluc and Cluc sequences added and reads were aligned and quantified using Bowtie/RSEM version 1.3.0. Alignment BAMs were then sorted and analyzed for RNA editing sites using REDitools [cite] with the following parameters: -t 8 -e -d -l -U [AG or TC]-p -u -m20 -T6-0 -W -v 1 -n 0.0. Any significant edits found in untransfected or EGFP-transfected conditions were considered to be SNPs or artifacts of the transfection and filtered out from the analysis of off-targets. Off-targets were considered significant if the Fisher's exact test yielded a p-value less than 0.5 and that at least 2 of 3 biological replicates identified the edit site.

For analyzing the predicted variant effects of each off-target, the list of off-target edit sites was analyzed using the variant annotation integrator (https://genome.ucsc.edu/cgi-bin/hgVai) as part of the UCSC genome browser suite of tools using the SIFT and PolyPhen-2 annotations. To declare whether the off-target genes are oncogenic, a database of oncogenic annotations from the COSMIC catalogue of somatic mutations in cancer (cancer.sanger.ac.uk).

For analyzing whether the REPAIR constructs perturbed RNA levels, the transcript per million (TPM) values output from the RSEM analysis were used for expression counts and transformed to log-space by taking the log 2(TPM+1). To find differentially regulated genes, a Student's t-test was performed on three targeting guide replicates versus three non-targeting guide replicates. The statistical analysis was only performed on genes with log 2(TPM+1) values greater than 2.5 and genes were only considered differentially regulated if they had a fold change greater than 2 or less than 0.8. Genes were reported if they had a false discovery rate of less than 0.01.

Results

Comprehensive Characterization of Cas13 Family Members in Mammalian Cells

Figure 31:
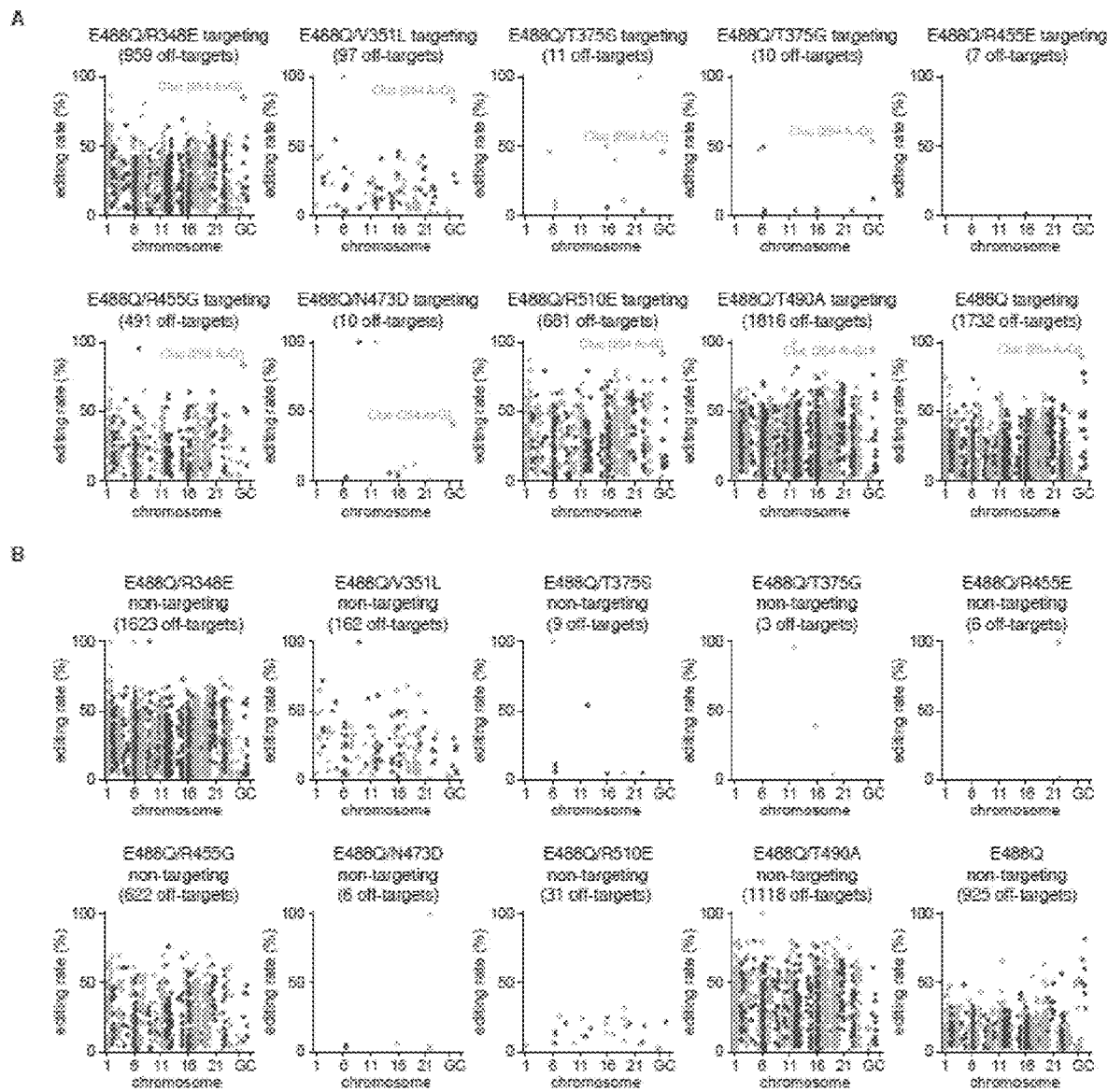
FIG. 31 shows transcriptome-wide specificity of RNA editing by dCas13b-ADAR2$_{DD}$(E488Q) mutants. A) Transcriptome-wide sites of significant RNA editing by dCas13b-ADAR2$_{DD}$(E488Q) mutants with a guide targeting Cluc. The on-target Cluc site (254 A>G) is highlighted in orange. B) Transcriptome-wide sites of significant RNA editing by dCas13b-ADAR2$_{DD}$(E488Q) mutants with a non-targeting guide.
Figure 32:
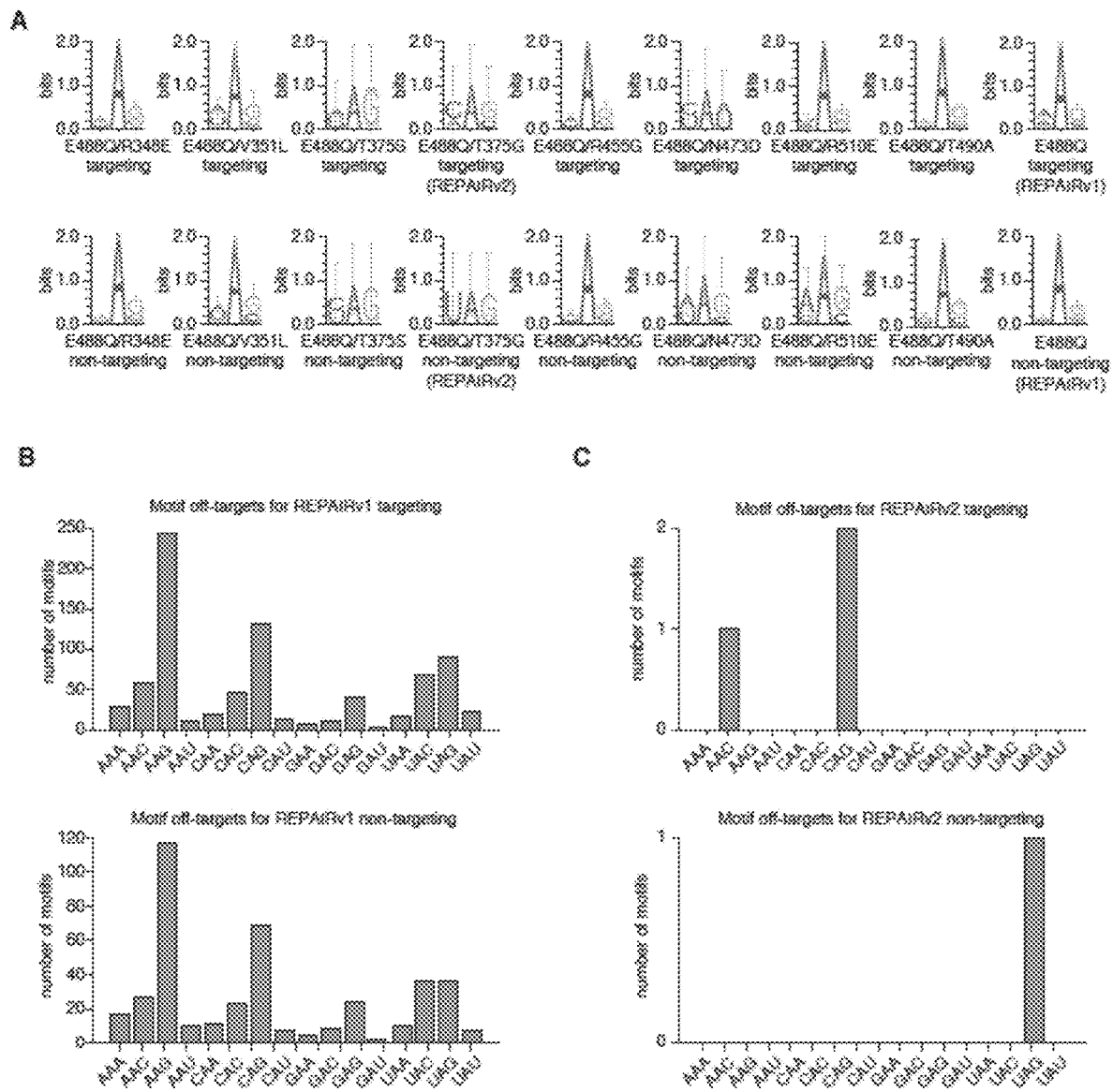
FIG. 32 shows characterization of motif biases in the off-targets of dCas13b-ADAR2$_{DD}$(E488Q) editing. A) For each dCas13b-ADAR2$_{DD}$(E488Q) mutant, the motif present across all A>G off-target edits in the transcriptome is shown. B) The distribution of off-target A>G edits per motif identity is shown for REPAIRv1 with targeting and non-targeting guide. C) The distribution of off-target A>G edits per motif identity is shown for REPAIRv2 with targeting and non-targeting guide.
Figure 33:
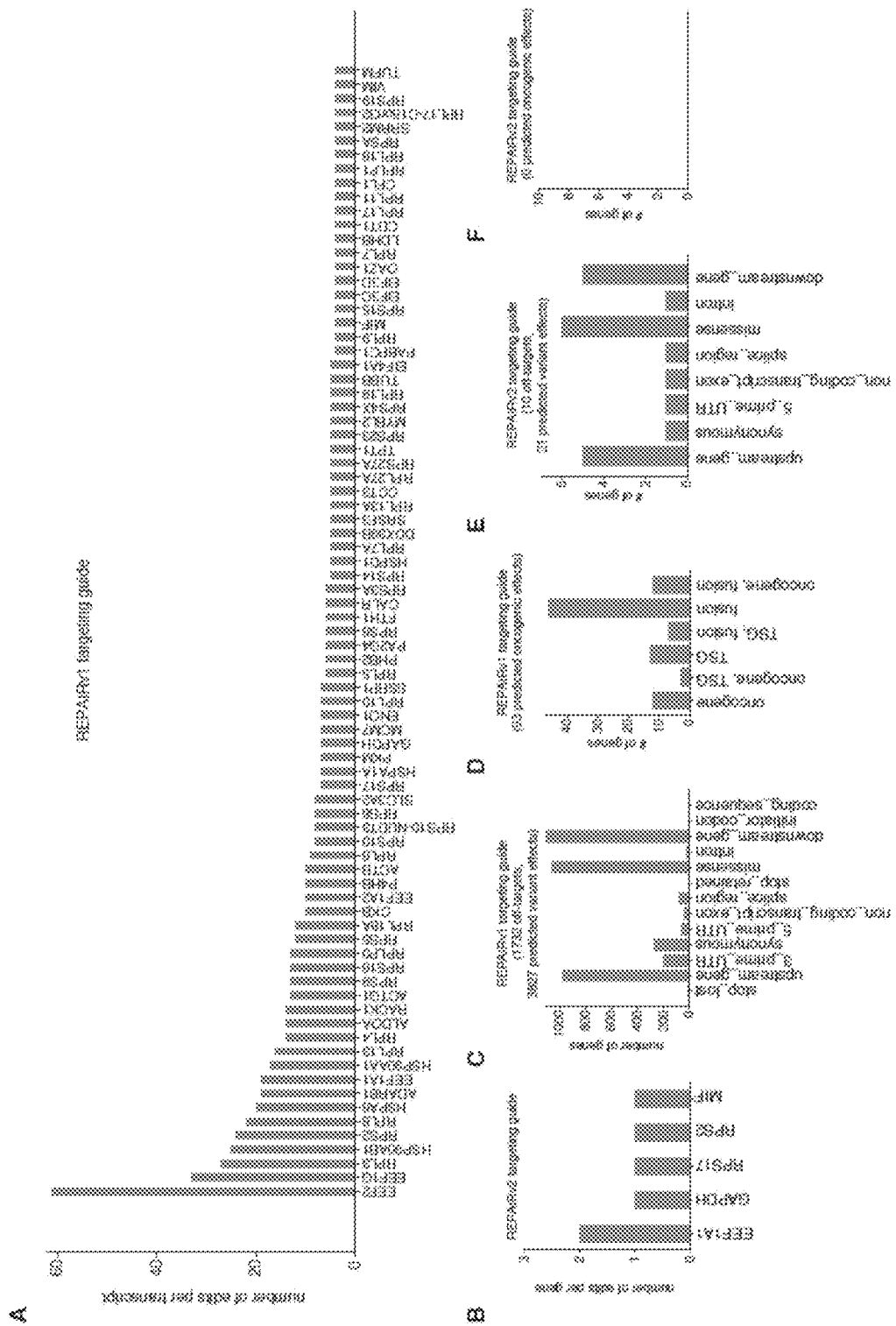
FIG. 33 shows further characterization of REPAIRv1 and REPAIRv2 off-targets. A) Histogram of the number of off-targets per transcript for REPAIRv1. B) Histogram of the number of off-targets per transcript for REPAIRv2. C) Variant effect prediction of REPAIRv1 off targets. D) Distribution of potential oncogenic effects of REPAIRv1 off targets. E) Variant effect prediction of REPAIRv2 off targets. F) Distribution of potential oncogenic effects of REPAIRv2 off targets.
Figure 34:
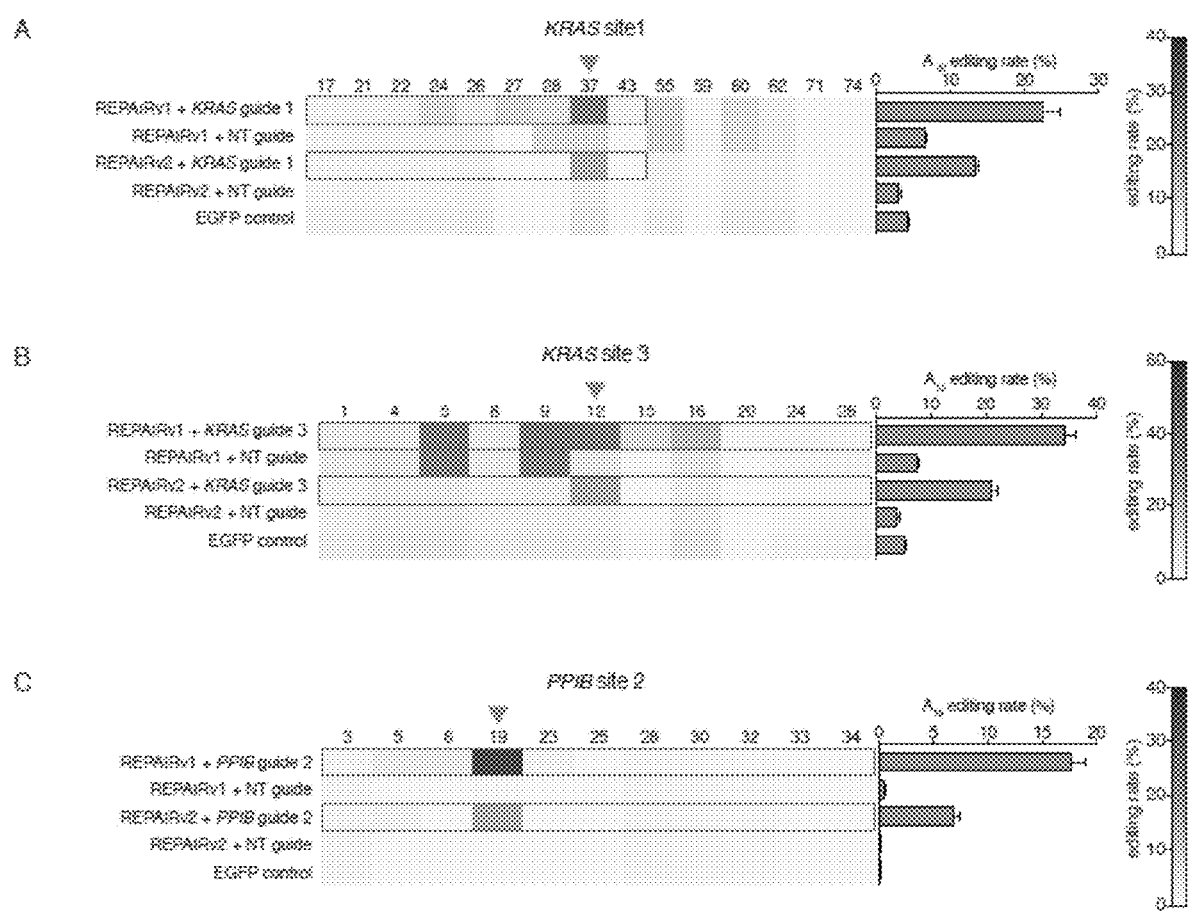
FIG. 34 shows RNA editing efficiency and specificity of REPAIRv1 and REPAIRv2. A) Quantitation of percent editing of KRAS with KRAS-targeting guide 1 at the targeted adenosine and neighboring sites for REPAIRv1 and REPAIRv2. B) Quantification of percent editing of KRAS with KRAS-targeting guide 3 at the targeted adenosine and neighboring sites for REPAIRv1 and REPAIRv2. C) Quantification of percent editing of PPIB with PPIB-targeting guide 2 at the targeted adenosine and neighboring sites for REPAIRv1 and REPAIRv2.
Figure 35:
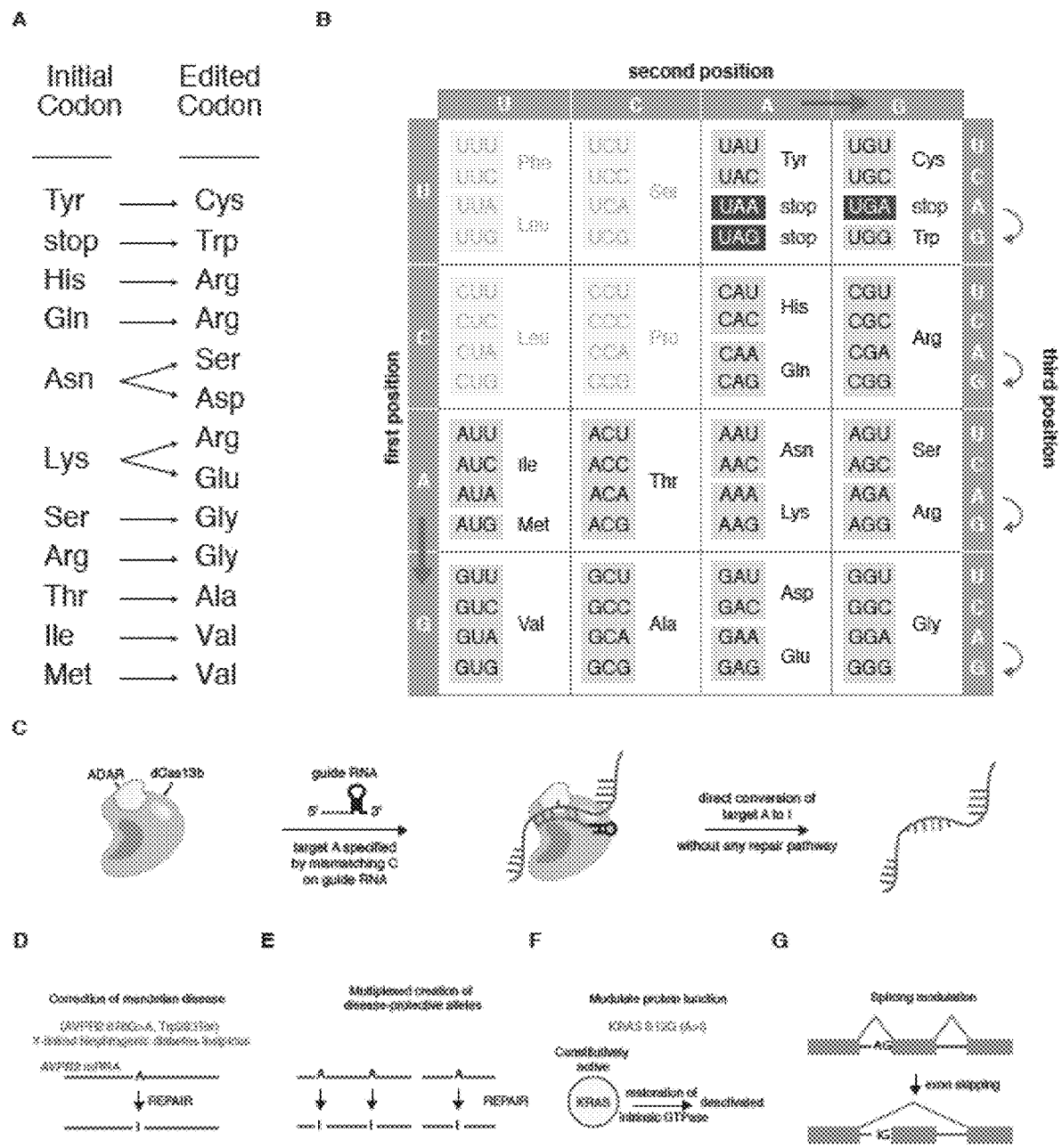
FIG. 35 shows demonstration of all potential codon changes with a A>G RNA editor. A) Table of all potential codon transitions enabled by A>I editing. B) A codon table demonstrating all the potential codon transitions enabled by A>I editing. C)
Figure 36A:
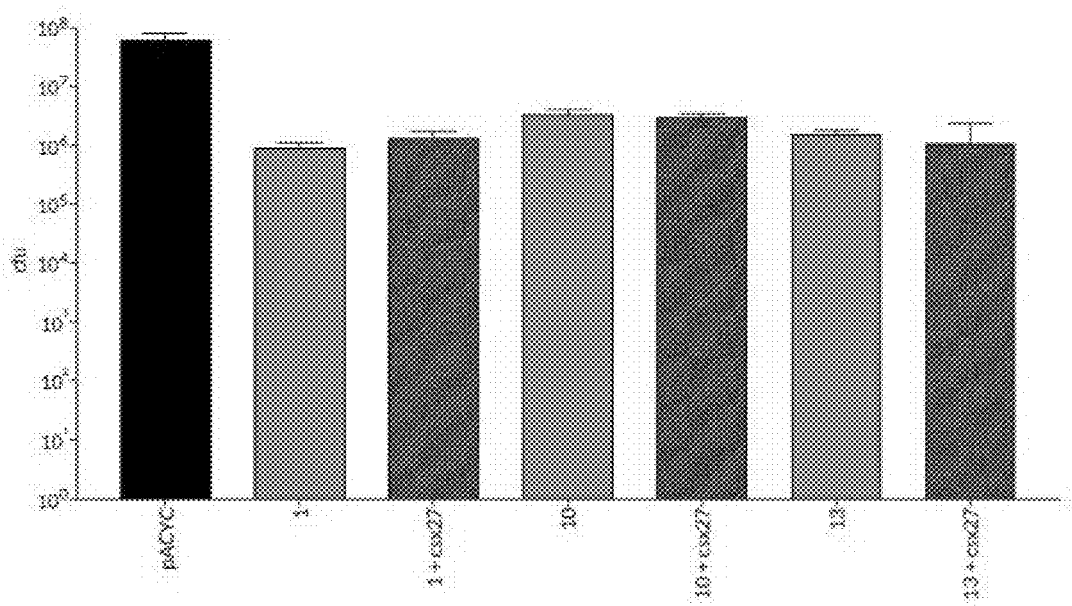
FIG. 36A-36B shows effect of Csx proteins on RNA interference. A) Comparison of Cas13b and Cas13b+Csx27 interference; B) Comparison of Cas13b and Cas13b+Csx28 interference.
Figure 36B:
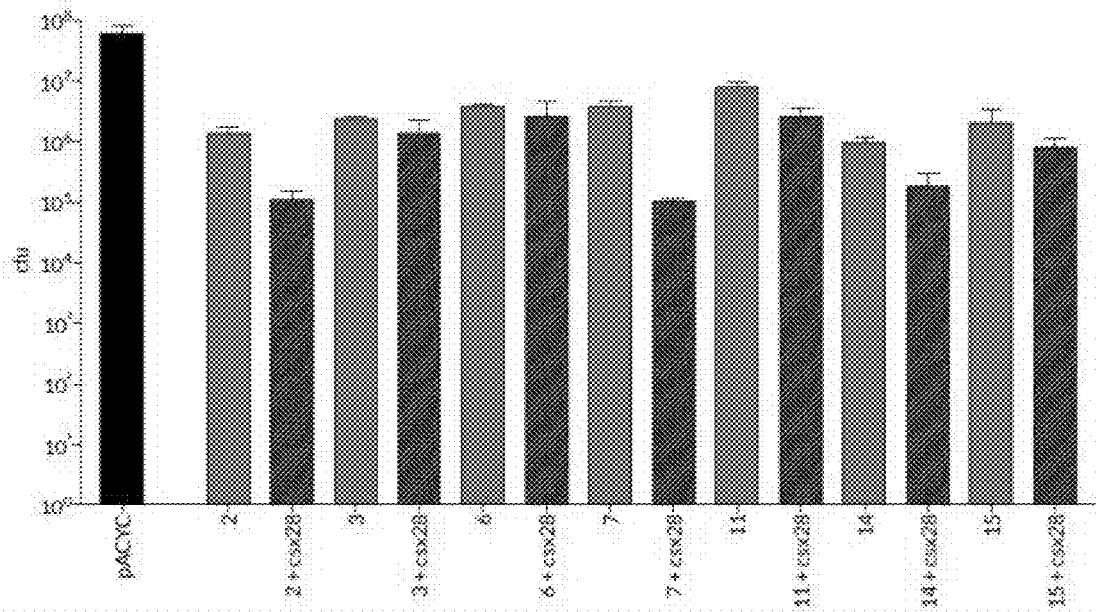
Figure 37A:
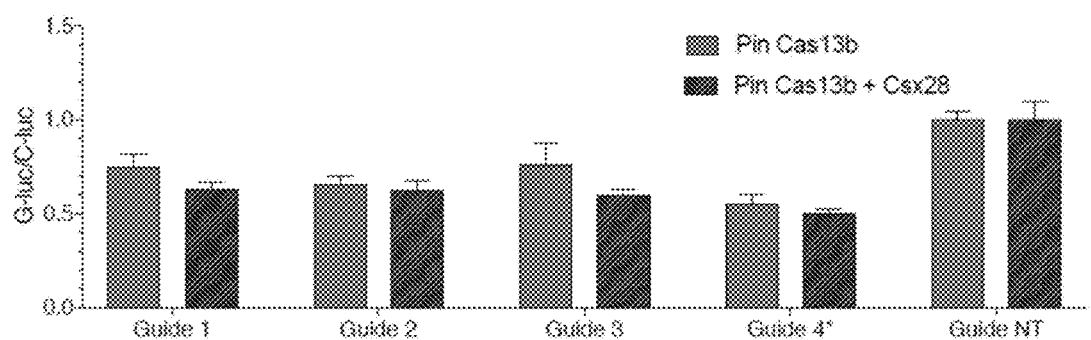
FIG. 37A-37F show comparison transcript knockdown by Cas13b and Cas13b+Csx28 via luciferase assay. A) Pin Cas13b (WP_036860899); B) Pbu Cas13b (WP_004343973); C) Rin Cas13b (WP_004919755); D) Pau Cas13b (WP_025000926); E) Pgu Cas13b (WP_039434803); F) Pig Cas13b (WP_053444417).
Figure 37B:
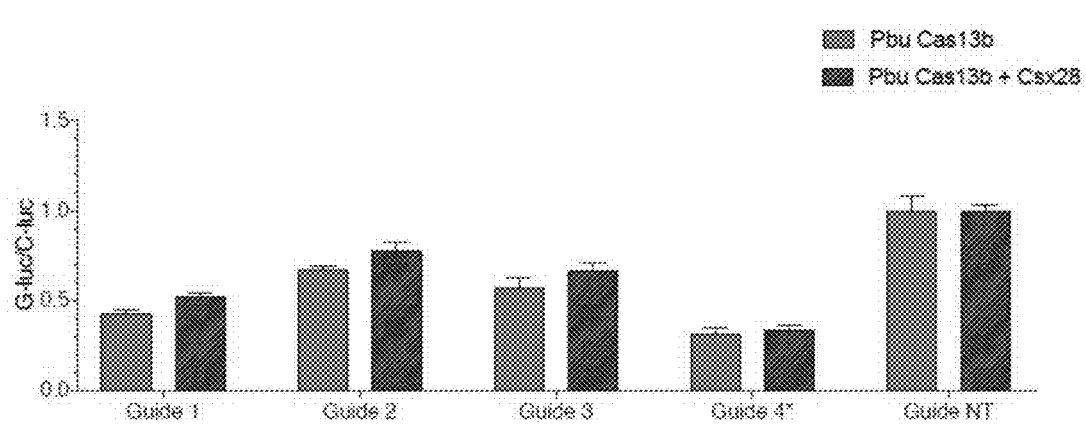
Figure 37C:
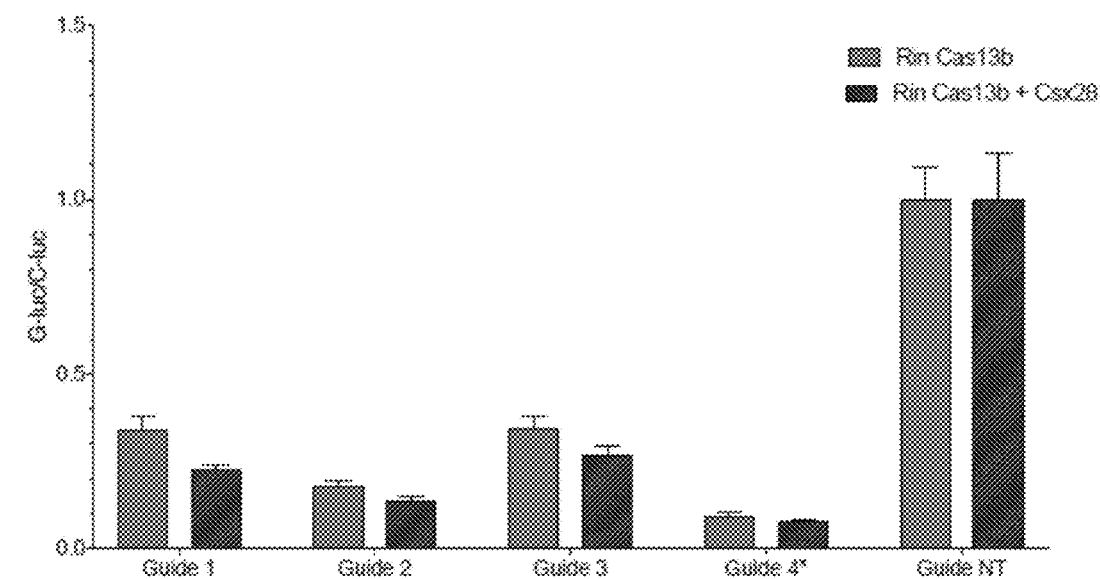
Figure 37D:
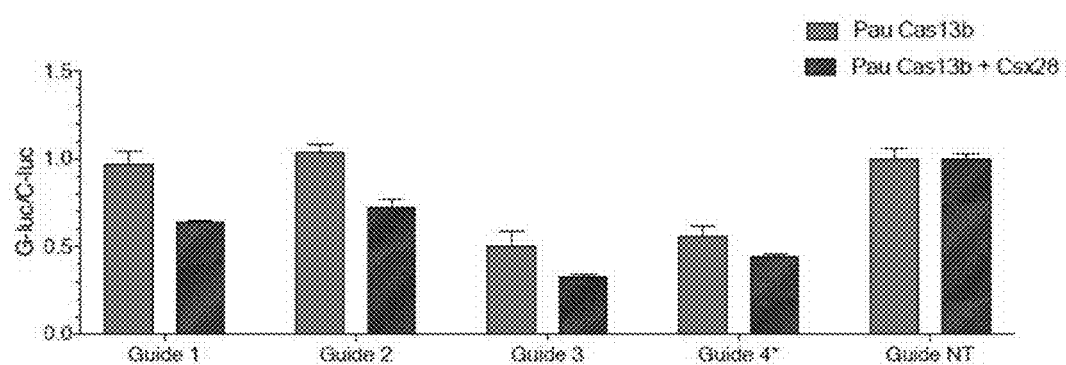
Figure 37E:
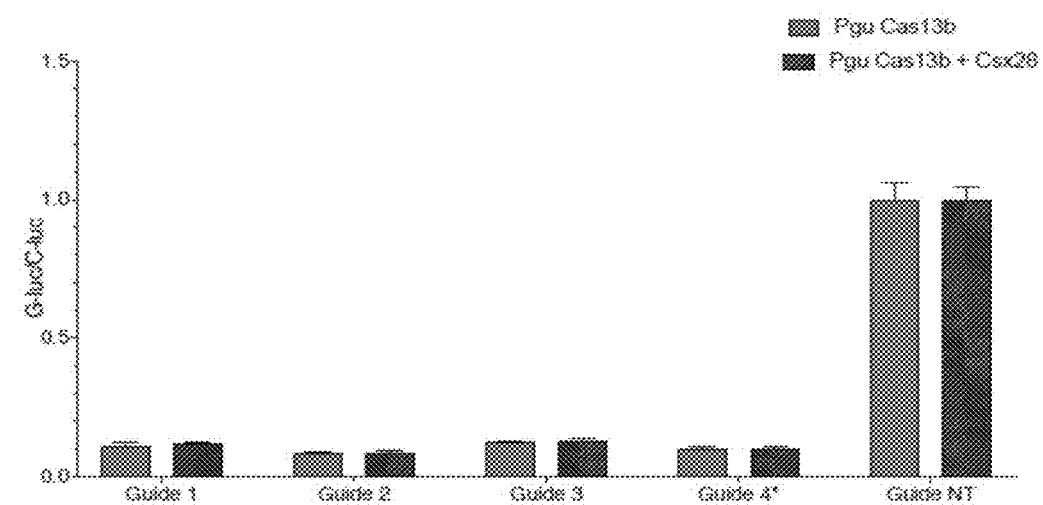
Figure 37F:
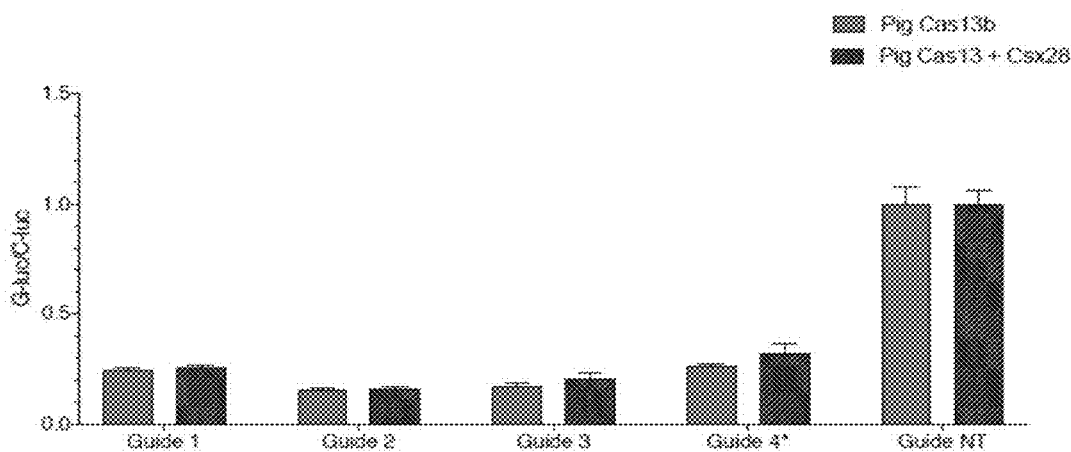

We previously developed LwaCas13a for mammalian knockdown applications, but it required an msfGFP stabilization domain for efficient knockdown and, although the specificity was high, knockdown efficiencies were not consistently below 50%(15). We sought to identify a more robust RNA-targeting CRISPR system by characterizing a genetically diverse set of Cas13 family members to assess their RNA knockdown activity in mammalian cells (FIG. 31A). We cloned 21 Cas13a, 15 Cas13b, and 7 Cas13c mammalian codon-optimized orthologs (Table 6) into an expression vector with N- and C-terminal nuclear export signal (NES) sequences and a C-terminal msfGFP to enhance protein stability. To assay interference in mammalian cells, we designed a dual reporter construct expressing the orthogonal *Gaussia* (Gluc) and *Cypridina* (Cluc) luciferases under separate promoters, which allows one luciferase to function as a measure of Cas13 interference activity and the other to serve as an internal control. For each ortholog, we designed PFS-compatible guide RNAs, using the Cas13b PFS motifs derived from an ampicillin interference assay (FIG. 55; Table 7; Supplementary Note 1) and the 3' H PFS from previous reports of Cas13a activity (10).

We transfected HEK293FT cells with Cas13 expression, guide RNA and reporter plasmids and quantified levels of the targeted Gluc 48 hours later. Testing two guide RNAs for each Cas13 ortholog revealed a range of activity levels, including five Cas13b orthologs with similar or increased interference across both guide RNAs relative to the recently characterized LwaCas13a (FIG. 49B). We selected these five Cas13b orthologs, as well as the top two Cas13a orthologs for further engineering.

We next tested for Cas13-mediated knockdown of Gluc without msfGFP, in order to select orthologs that do not require stabilization domains for robust activity. We hypothesized that, in addition to msfGFP, Cas13 activity could be affected by subcellular localization, as previously reported for optimization of LwaCas13a(15). Therefore, we tested the interference activity of the seven selected Cas13 orthologs C-terminally fused to one of six different localization tags without msfGFP. Using the luciferase reporter assay, we found that PspCas13b and PguCas13b C-terminally fused to the HIV Rev gene NES and RanCas13b C-terminally fused to the MAPK NES had the highest levels of interference activity (FIG. 56A). To further distinguish activity levels of the top orthologs, we compared the three optimized Cas13b constructs to the optimal LwaCas13a-msfGFP fusion and shRNA for their ability to knockdown the KRAS transcript using position-matched guides (FIG. 56B). We observed the highest levels interference for PspCas13b (average knockdown 62.9%) and thus selected this for further comparison to LwaCas13 a.

To more rigorously define the activity level of PspCas13b and LwaCas13a we designed position matched guides tiling along both Gluc and Cluc and assayed their activity using our luciferase reporter assay. We tested 93 and 20 position matched guides targeting Gluc and Cluc, respectively, and found that PspCas13b had consistently increased levels of knockdown relative to LwaCas13a (average of 92.3% for PspCas13b vs. 40.1% knockdown for LwaCas13a) (FIG. 49C,D).

Specificity of Cas13 Mammalian Interference Activity

To characterize the interference specificities of PspCas13b and LwaCas13a we designed a plasmid library of luciferase targets containing single mismatches and double mismatches throughout the target sequence and the three flanking 5' and 3' base pairs (FIG. 56C). We transfected HEK293FT cells with either LwaCas13a or PspCas13b, a fixed guide RNA targeting the unmodified target sequence, and the mismatched target library corresponding to the appropriate system. We then performed targeted RNA sequencing of uncleaved transcripts to quantify depletion of mismatched target sequences. We found that LwaCas13a and PspCas13b had a central region that was relatively intolerant to single mismatches, extending from base pairs 12-26 for the PspCas13b target and 13-24 for the LwaCas13a target (FIG. 56D). Double mismatches were even less tolerated than single mutations, with little knockdown activity observed over a larger window, extending from base pairs 12-29 for PspCas13b and 8-27 for LwaCas13a in their respective targets (FIG. 56E). Additionally, because there are mismatches included in the three nucleotides flanking the 5' and 3' ends of the target sequence, we could assess PFS constraints on Cas13 knockdown activity. Sequencing showed that almost all PFS combinations allowed robust knockdown, indicating that a PFS constraint for interference in mammalian cells likely does not exist for either enzyme tested. These results indicate that Cas13a and Cas13b display similar sequence constraints and sensitivities against mismatches.

We next characterized the interference specificity of PspCas13b and LwaCas13a across the mRNA fraction of the transcriptome. We performed transcriptome-wide mRNA sequencing to detect significant differentially expressed genes. LwaCas13a and PspCas13b demonstrated robust knockdown of Gluc (FIG. 49E,F) and were highly specific compared to a position-matched shRNA, which showed hundreds of off-targets (FIG. 49G).

Cas13-ADAR Fusions Enable Targeted RNA Editing

Given that PspCas13b achieved consistent, robust, and specific knockdown of mRNA in mammalian cells, we envisioned that it could be adapted as an RNA binding platform to recruit the deaminase domain of ADARs (ADAR$_{DD}$) for programmable RNA editing. To engineer a PspCas13b lacking nuclease activity (dPspCas13b, referred to as dCas13b from here), we mutated conserved catalytic residues in the HEPN domains and observed loss of luciferase RNA knockdown activity (FIG. 57A). We hypothesized that a dCas13b-ADAR$_{DD}$ fusion could be recruited by a guide RNA to target adenosines, with the hybridized RNA creating the required duplex substrate for ADAR activity (FIG. 50A). To enhance target adenosine deamination rates we introduced two additional modifications to our initial RNA editing design: we introduced a mismatched cytidine opposite the target adenosine, which has been previously reported to increase deamination frequency, and fused dCas13b with the deaminase domains of human ADAR1 or ADAR2 containing hyperactivating mutations to enhance catalytic activity (ADAR1$_{DD}$(E1008Q)(25) or ADAR2$_{DD}$ (E488Q)(19)).

To test the activity of dCas13b-ADAR$_{DD}$ we generated an RNA-editing reporter on Cluc by introducing a nonsense mutation (W85X (UGG→UAG)), which could functionally be repaired to the wildtype codon through A→I editing (FIG. 50B) and then be detected as restoration of Cluc luminescence. We evenly tiled guides with spacers 30, 50, 70 or 84 nucleotides in length across the target adenosine to determine the optimal guide placement and design (FIG. 50C). We found that dCas13b-ADAR1$_{DD}$ required longer guides to repair the Cluc reporter, while dCas13b-ADAR2$_{DD}$ was functional with all guide lengths tested (FIG. 50C). We also found that the hyperactive E488Q mutation improved editing efficiency, as luciferase restoration with the wildtype ADAR2$_{DD}$ was reduced (FIG. 57B). From this demonstration of activity, we chose dCas13b-ADAR2$_{DD}$(E488Q) for further characterization and designated this approach as RNA Editing for Programmable A to I Replacement version 1 (REPAIRv1).

To validate that restoration of luciferase activity was due to bona fide editing events, we measured editing of Cluc transcripts subject to REPAIRv1 directly via reverse transcription and targeted next-generation sequencing. We tested 30- and 50-nt spacers around the target site and found that both guide lengths resulted in the expected A to I edit, with 50-nt spacers achieving higher editing percentages (FIG. 50D,E, FIG. 57C). We also observed that 50-nt spacers had an increased propensity for editing at non-targeted adenosines, likely due to increased regions of duplex RNA (FIG. 50E, FIG. 57C).

We next targeted an endogenous gene, PPIB. We designed 50-nt spacers tiling PPIB and found that we could edit the PPIB transcript with up to 28% editing efficiency (FIG. 57D). To test if REPAIR could be further optimized, we modified the linker between dCas13b and ADAR2$_{DD}$ (E488Q) (FIG. 57E, Table 8) and found that linker choice modestly affected luciferase activity restoration.

Defining the Sequence Parameters for RNA Editing

Given that we could achieve precise RNA editing at a test site, we wanted to characterize the sequence constraints for programming the system against any RNA target in the transcriptome. Sequence constraints could arise from dCas13b targeting limitations, such as the PFS, or from ADAR sequence preferences(26). To investigate PFS constraints on REPAIRv1, we designed a plasmid library carrying a series of four randomized nucleotides at the 5' end of a target site on the Cluc transcript (FIG. 51A). We targeted the center adenosine within either a UAG or AAC motif and found that for both motifs, all PFSs demonstrated detectable levels of RNA editing, with a majority of the PFSs having greater than 50% editing at the target site (FIG. 51B). Next, we sought to determine if the ADAR2$_{DD}$ in REPAIRv1 had any sequence constraints immediately flanking the targeted base, as has been reported previously for ADAR2DD(26) .We tested every possible combination of 5' and 3' flanking nucleotides directly surrounding the target adenosine (FIG. 51C), and found that REPAIRv1 was capable of editing all motifs (FIG. 51D). Lastly, we analyzed whether the identity of the base opposite the target A in the spacer sequence affected editing efficiency and found that an A-C mismatch had the highest luciferase restoration with A-G, A-U, and A-A having drastically reduced REPAIRv1 activity (FIG. 57F).

Correction of Disease-Relevant Human Mutations Using REPAIRv1

To demonstrate the broad applicability of the REPAIRv1 system for RNA editing in mammalian cells, we designed REPAIRv1 guides against two disease relevant mutations: 878G>A (AVPR2 W293X) in X-linked Nephrogenic diabetes insipidus and 1517G>A (FANCC W506X) in Fanconi anemia. We transfected expression constructs for cDNA of genes carrying these mutations into HEK293FT cells and tested whether REPAIRv1 could correct the mutations. Using guide RNAs containing 50-nt spacers, we were able to achieve 35% correction of AVPR2 and 23% correction of FANCC (FIG. 52A-D). We then tested the ability of REPAIRv1 to correct 34 different disease-relevant G>A mutations (Table 9) and found that we were able to achieve significant editing at 33 sites with up to 28% editing efficiency (FIG. 52E). The mutations we chose are only a fraction of the pathogenic G to A mutations (5,739) in the ClinVar database, which also includes an additional 11,943 G to A variants (FIG. 52F and FIG. 58). Because there are no sequence constraints, REPAIRv1 is capable of potentially editing all these disease relevant mutations, especially given that we observed significant editing regardless of the target motif (FIG. 51C and FIG. 52G).

Delivering the REPAIRv1 system to diseased cells is a prerequisite for therapeutic use, and we therefore sought to design REPAIRv1 constructs that could be packaged into therapeutically relevant viral vectors, such as adeno-associated viral (AAV) vectors. AAV vectors have a packaging limit of 4.7 kb, which cannot accommodate the large size of dCas13b-ADAR$_{DD}$ (4473 bp) along with promoter and expression regulatory elements. To reduce the size, we tested a variety of N-terminal and C-terminal truncations of dCas13 fused to ADAR2$_{DD}$(E488Q) for RNA editing activity. We found that all C-terminal truncations tested were still functional and able to restore luciferase signal (FIG. 59), and the largest truncation, C-terminal Δ984-1090 (total size of the fusion protein 4,152 bp) was small enough to fit within the packaging limit of AAV vectors.

Transcriptome-Wide Specificity of REPAIRv1

Although RNA knockdown with PspCas13b was highly specific, in our luciferase tiling experiments, we observed off-target adenosine editing within the guide:target duplex (FIG. 50E). To see if this was a widespread phenomenon, we tiled an endogenous transcript, KRAS, and measured the degree of off-target editing near the target adenosine (FIG. 53A). We found that for KRAS, while the on-target editing rate was 23%, there were many sites around the target site that also had detectable A to G edits (FIG. 53B).

Because of the observed off-target editing within the guide:target duplex, we evaluated all possible transcriptome off-targets by performing RNA sequencing on all mRNAs. RNA sequencing revealed that there was a significant number A to G off-target events, with 1,732 off-targets in the targeting condition and 925 off-targets in the non-targeting condition, with 828 off-targets overlapping (FIG. 53C,D). Of all the editing sites across the transcriptome, the on-target editing site had the highest editing rate, with 89% A to G conversion.

Given the high specificity of Cas13 targeting, we reasoned that the off-targets may arise from ADAR. Two RNA-guided ADAR systems have been described previously (FIG. 60A). The first utilizes a fusion of ADAR2$_{DD}$ to the small viral protein lambda N (λ N), which binds to the BoxB-λ RNA hairpin(22). A guide RNA with double BoxB-λ hairpins guides ADAR2$_{DD}$ to edit sites encoded in the guide RNA (23). The second design utilizes full length ADAR2 (ADAR2) and a guide RNA with a hairpin that the double strand RNA binding domains (dsRBDs) of ADAR2 recognize(21, 24). We analyzed the editing efficiency of these two systems compared to REPAIRv1 and found that the BoxB-ADAR2 and ADAR2 systems demonstrated 63% and 36% editing rates, respectively, compared to the 89% editing rate achieved by REPAIRv1 (FIG. 60B-E). Additionally, the BoxB and ADAR2 systems created 2018 and 174 observed off targets, respectively, in the targeting guide conditions, compared to the 1,229 off targets in the REPAIRv1 targeting guide condition. Notably, all the conditions with the two ADAR2DD-based systems (REPAIRv1 and BoxB) showed a high percentage of overlap in their off-targets while the ADAR2 system had a largely distinct set of off-targets (FIG. 60F). The overlap in off-targets between the targeting and non-targeting conditions and between REPAIRv1 and BoxB conditions suggest ADAR2$_{DD}$ drove off-targets independent of dCas13 targeting (FIG. 60F).

Improving Specificity of REPAIRv1 Through Rational Protein Engineering

To improve the specificity of REPAIR, we employed structure-guided protein engineering of ADAR2$_{DD}$(E488Q). Because of the guide-independent nature of off-targets, we hypothesized that destabilizing ADAR2$_{DD}$(E488Q)-RNA binding would selectively decrease off-target editing, but maintain on-target editing due to increased local concentration from dCas13b tethering of ADAR2$_{DD}$(E488Q) to the target site. We mutagenized ADAR2$_{DD}$(E488Q) residues previously determined to contact the duplex region of the target RNA (FIG. 54A)(18) on the ADAR2$_{DD}$(E488Q) background. To assess efficiency and specificity, we tested 17 single mutants with both targeting and non-targeting guides, under the assumption that background luciferase restoration in the non-targeting condition detected would be indicative of broader off-target activity. We found that mutations at the selected residues had significant effects on the luciferase activity for targeting and non-targeting guides (FIG. 54A,B, FIG. 61A). A majority of mutants either significantly improved the luciferase activity for the targeting guide or increased the ratio of targeting to non-targeting guide activity, which we termed the specificity score (FIG. 54A,B). We selected a subset of these mutants (FIG. 54B) for transcriptome-wide specificity profiling by next generation sequencing. As expected, off-targets measured from transcriptome-wide sequencing correlated with our specificity score (FIG. 61B) for mutants. We found that with the exception of ADAR2DD(E488Q/R455E), all sequenced REPAIRv1 mutants could effectively edit the reporter transcript (FIG. 54C), with many mutants showing reduction in the number of off-targets (FIGS. 61C, 62). We further explored the surrounding motifs of off-targets for specificity mutants, and found that REPAIRv1 and most of the engineered mutants exhibited a strong 3' G preference for their edits, in agreement with the characterized ADAR2 motif (FIG. 63A)(26). We selected the mutant ADAR2$_{DD}$(E488Q/T375G) for future experiments, as it had the highest percent editing of the four mutants with the lowest numbers of transcriptome-wide off targets and termed it REPAIRv2. Compared to REPAIRv1, REPAIRv2 exhibited increased specificity, with a reduction from 1732 to 10 transcriptome off-targets (FIG. 54D). In the region surrounding the targeted adenosine in Cluc, REPAIRv2 had reduced off-target editing, visible in sequencing traces (FIG. 54E). In motifs derived from next-generation sequencing, REPAIRv1 presented a strong preference towards 3' G, but showed off-targeting edits for all motifs (FIG. 63B); by contrast, REPAIRv2 only edited the strongest off-target motifs (FIG. 63C). The distribution of edits on transcripts was heavily skewed, with highly-edited genes having over 60 edits (FIG. 64A,B), whereas REPAIRv2 only edited one transcript (EEFIA1) multiple times (FIG. 64D-F). REPAIRv1 off-target edits were predicted to result in numerous variants, including 1000 missense mutations (FIG. 64C) with 93 oncogenic events (FIG. 64D). In contrast, REPAIRv2 only had 6 missense mutations (FIG. 64E), none of which had oncogenic consequences (FIG. 64F). This reduction in predicted off-target effects distinguishes REPAIRv2 from other RNA editing approaches.

We targeted REPAIRv2 to endogenous genes to test if the specificity-enhancing mutations reduced nearby edits in target transcripts while maintaining high-efficiency on-target editing. For guides targeting either KRAS or PPIB, we found that REPAIRv2 had no detectable off-target edits, unlike REPAIRv1, and could effectively edit the on-target adenosine at 27.1% and 13%, respectively (FIG. 54F,G). This specificity extended to additional target sites, including regions that demonstrate high-levels of background in non-targeting conditions for REPAIRv1, such as other KRAS or PPIB target sites (FIG. 65). Overall, REPAIRv2 eliminated off-targets in duplexed regions around the edited adenosine and showed dramatically enhanced transcriptome-wide specificity.

CONCLUSION

We have shown here that the RNA-guided RNA-targeting type VI-B effector Cas13b is capable of highly efficient and specific RNA knockdown, providing the basis for improved tools for interrogating essential genes and non-coding RNA as well as controlling cellular processes at the transcriptomic level. Catalytically inactive Cas13b (dCas13b) retains programmable RNA binding capability, which we leveraged here by fusing dCas13b to the adenosine deaminase ADAR2 to achieve precise A to I edits, a system we term REPAIRv1 (RNA Editing for Programmable A to I Replacement version 1). Further engineering of the system produced REPAIRv2, a method with comparable or increased activity relative to current editing platforms with dramatically improved specificity.

Although Cas13b exhibits high fidelity, our initial results with dCas13b-ADAR2DD fusions revealed thousands of off-targets. To address this, we employed a rational mutagenesis strategy to vary the ADAR2DD residues that contact the RNA duplex, identifying a variant, ADAR2$_{DD}$(E488Q/T375G), capable of precise, efficient, and highly specific editing when fused to dCas13b. Editing efficiency with this variant was comparable to or better than that achieved with two currently available systems, BoxB-ADAR$_{DD}$ or ADAR2 editing. Moreover, the REPAIRv2 system created only 10 observable off-targets in the whole transcriptome, at least an order of magnitude better than both alternative editing technologies.

The REPAIR system offers many advantages compared to other nucleic acid editing tools. First, the exact target site can be encoded in the guide by placing a cytidine within the guide extension across from the desired adenosine to create a favorable A-C mismatch ideal for ADAR editing activity. Second, Cas13 has no targeting sequence constraints, such as a PFS or PAM, and no motif preference surrounding the target adenosine, allowing any adenosine in the transcriptome to be potentially targeted with the REPAIR system. We do note, however, that DNA base editors can target either the sense or anti-sense strand, while the REPAIR system is limited to transcribed sequences, thereby constraining the total number of possible editing sites we could target. However, due to the more flexible nature of targeting with REPAIR, this system can effect more edits within ClinVar (FIG. 52C) than Cas9-DNA base editors. Third, the REPAIR system directly deaminates target adenosines to inosines and does not rely on endogenous repair pathways, such as base-excision or mismatch repair, to generate desired editing outcomes. Thus, REPAIR should be possible in non-dividing cells that cannot support other forms of editing. Fourth, RNA editing can be transient, allowing the potential for temporal control over editing outcomes. This property will likely be useful for treating diseases caused by temporary changes in cell state, such as local inflammation.

The REPAIR system provides multiple opportunities for additional engineering. Cas13b possesses pre-crRNA processing activity (13), allowing for multiplex editing of multiple variants, which alone might not alter disease risk, but together might have additive effects and disease-modifying potential. Extension of our rational design approach, such as combining promising mutations, could further increase the specificity and efficiency of the system, while unbiased screening approaches could identify additional residues for improving REPAIR activity and specificity.

Currently, the base conversions achievable by REPAIR are limited to generating inosine from adenosine; additional fusions of dCas13 with other catalytic RNA editing domains, such as APOBEC, could enable cytidine to uridine editing. Additionally, mutagenesis of ADAR could relax the substrate preference to target cytidine, allowing for the enhanced specificity conferred by the duplexed RNA substrate requirement to be exploited by C→U editors. Adenosine to inosine editing on DNA substrates may also be possible with catalytically inactive DNA-targeting CRISPR effectors, such as dCas9 or dCpf1, either through formation of DNA-RNA heteroduplex targets(27) or mutagenesis of the ADAR domain.

REPAIR could be applied towards a range of therapeutic indications where A to I (A to G) editing can reverse or slow disease progression (FIG. 66). First, expression of REPAIR for targeting causal, Mendelian G to A mutations in disease-relevant tissues could be used to revert deleterious mutations and treat disease. For example, stable REPAIR expression via AAV in brain tissue could be used to correct the GRIN2A missense mutation c.2191G>A (Asp731Asn) that causes focal epilepsy(28) or the APP missense mutation c.2149G>A (Val717Ile) causing early-onset Alzheimer's disease(29). Second, REPAIR could be used to treat disease by modifying the function of proteins involved in disease-related signal transduction. For instance, REPAIR editing would allow the re-coding of some serine, threonine and tyrosine residues that are the targets of kinases (FIG. 66). Phosphorylation of these residues in disease-relevant proteins affects disease progression for many disorders including Alzheimer's disease and multiple neurodegenerative conditions(30). Third, REPAIR could be used to change the sequence of expressed, risk-modifying G to A variants to pre-emptively decrease the chance of entering a disease state for patients. The most intriguing case are the 'protective' risk-modifying alleles, which dramatically decrease the chance of entering a disease state, and in some cases, confer additional health benefits. For instance, REPAIR could be used to functionally mimic A to G alleles of PCSK9 and IFIH1 that protect against cardiovascular disease and psoriatic arthritis(31), respectively. Last, REPAIR can be used to therapeutically modify splice acceptor and donor sites for exon modulation therapies. REPAIR can change AU to IU or AA to AI, the functional equivalent of the consensus 5' splice donor or 3' splice acceptor sites respectively, creating new splice junctions. Additionally, REPAIR editing can mutate the consensus 3' splice acceptor site from AG→IG to promote skipping of the adjacent downstream exon, a therapeutic strategy that has received significant interest for the treatment of DMD. Modulation of splice sites could have broad applications in diseases where anti-sense oligos have had some success, such as for modulation of SMN2 splicing for treatment of spinal muscular atrophy(32).

We have demonstrated the use of the PspCas13b enzyme as both an RNA knockdown and RNA editing tool. The dCas13b platform for programmable RNA binding has many applications, including live transcript imaging, splicing modification, targeted localization of transcripts, pull down of RNA-binding proteins, and epitranscriptomic modifications. Here, we used dCas13 to create REPAIR, adding to the existing suite of nucleic acid editing technologies. REPAIR provides a new approach for treating genetic disease or mimicking protective alleles, and establishes RNA editing as a useful tool for modifying genetic function.

TABLE 6

Cas13 Orthologs used in this study

| Cas13 ID | Cas13 abbreviation | Host Organism | Protein Accession |
|---|---|---|---|
| Cas13a1 | LshCas13a | *Leptotrichia shahii* | WP_018451595.1 |
| Cas13a2 | LwaCas13a | *Leptotrichia wadei* (Lw2) | WP_021746774.1 |
| Cas13a3 | LseCas13a | *Listeria seeligeri* | WP_012985477.1 |
| Cas13a4 | LbmCas13a | *Lachnospiraceae bacterium* MA2020 | WP_044921188.1 |
| Cas13a5 | LbnCas13a | *Lachnospiraceae bacterium* NK4A179 | WP_022785443.1 |
| Cas13a6 | CamCas13a | *[Clostridium] aminophilum* DSM 10710 | WP_031473346.1 |
| Cas13a7 | CgaCas13a | *Carnobacterium gallinarum* DSM 4847 | WP_034560163.1 |
| Cas13a8 | Cga2Cas13a | *Carnobacterium gallinarum* DSM 4847 | WP_034563842.1 |
| Cas13a9 | Pprcas13a | *Paludibacter propionicigenes* WB4 | WP_013443710.1 |
| Cas13a10 | LweCas13a | *Listeria weihenstephanensis* FSL R9-0317 | WP_036059185.1 |
| Cas13a11 | LbfCas13a | *Listeriaceae bacterium* FSL M6-0635 | WP_036091002.1 |
| Cas13a12 | Lwa2cas13a | *Leptotrichia wadei* F0279 | WP_021746774.1 |
| Cas13a13 | RcsCas13a | *Rhodobacter capsulatus* SB 1003 | WP_013067728.1 |
| Cas13a14 | RcrCas13a | *Rhodobacter capsulatus* R121 | WP_023911507.1 |
| Cas13a15 | RcdCas13a | *Rhodobacter capsulatus* DE442 | WP_023911507.1 |
| Cas13a16 | LbuCas13a | *Leptotrichia buccalis* C-1013-b | WP_015770004.1 |
| Cas13a17 | HheCas13a | *Herbinix hemicellulosilytica* | CRZ35554.1 |
| Cas13a18 | EreCas13a | *[Eubacterium] rectale* | WP_055061018.1 |

TABLE 6-continued

Cas13 Orthologs used in this study

| Cas13 ID | Cas13 abbreviation | Host Organism | Protein Accession |
|---|---|---|---|
| Cas13a19 | EbaCas13a | Eubacteriaceae bacterium CHKCI004 | WP_090127496.1 |
| Cas13a20 | BmaCas13a | *Blautia* sp. Marseille-P2398 | WP_062808098.1 |
| Cas13a21 | LspCas13a | *Leptotrichia* sp. oral taxon 879 str. F0557 | WP_021744063.1 |
| Cas13b1 | BzoCas13b | *Bergeyella zoohelcum* | WP_002664492 |
| Cas13b2 | PinCas13b | *Prevotella intermedia* | WP_036860899 |
| Cas13b3 | PbuCas13b | *Prevotella buccae* | WP_004343973 |
| Cas13b4 | AspCas13b | *Alistipes* sp. ZOR0009 | WP_047447901 |
| Cas13b5 | PsmCas13b | *Prevotella* sp. MA2016 | WP_036929175 |
| Cas13b6 | RanCas13b | *Riemerella anatipestifer* | WP_004919755 |
| Cas13b7 | PauCas13b | *Prevotella aurantiaca* | WP_025000926 |
| Cas13b8 | PsaCas13b | *Prevotella saccharolytica* | WP_051522484 |
| Cas13b9 | Pin2Cas143b | *Prevotella intermedia* | WP_061868553 |
| Cas13b10 | CcaCas13b | *Capnocytophaga canimorsus* | WP_013997271 |
| Cas13b11 | PguCas13b | *Porphyromonas gulae* | WP_039434803 |
| Cas13b12 | PspCas13b | *Prevotella* sp. P5-125 | WP_044065294 |
| Cas13b13 | FbrCas13b | *Flavobacterium branchiophilum* | WP_014084666 |
| Cas13b14 | PgiCas13b | *Porphyromonas gingivalis* | WP_053444417 |
| Cas13b15 | Pin3Cas13b | *Prevotella intermedia* | WP_050955369 |
| Cas13c1 | FnsCas13c | *Fusobacterium necrophorum* subsp. *funduliforme* ATCC 51357 contig00003 | WP_005959231.1 |
| Cas13c2 | FndCas13c | *Fusobacterium necrophorum* DJ-2 contig0065, whole genome shotgun sequence | WP_035906563.1 |
| Cas13c3 | FnbCas13c | *Fusobacterium necrophorum* BFTR-1 contig0068 | WP_035935671.1 |
| Cas13c4 | FnfCas13c | *Fusobacterium necrophorum* subsp. *funduliforme* 1_1_36S cont1.14 | EHO19081.1 |
| Cas13c5 | FpeCas13c | *Fusobacterium perfoetens* ATCC 29250 T364DRAFT_scaffold00009.9_C | WP_027128616.1 |
| Cas13c6 | FulCas13c | *Fusobacterium ulcerans* ATCC 49185 cont2.38 | WP_040490876.1 |
| Cas13c7 | AspCas13c | *Anaerosalibacter* sp. ND1 genome assembly *Anaerosalibacter massiliensis* ND1 | WP_042678931.1 |

TABLE 7

PFS cutoffs in bacterial screens

| Cas13b ortholog | Key | −Log$_2$ depletion score used to generate PFS motif |
|---|---|---|
| *Bergeyella zoohelcum* | 1 | 2 |
| *Prevotella intermedia* locus 1 | 2 | 1 |
| *Prevotella buccae* | 3 | 3 |
| *Alistipes* sp. ZOR0009 | 4 | 1 |
| *Prevotella* sp. MA2016 | 5 | 2 |
| *Riemerella anatipestifer* | 6 | 4 |
| *Prevotella aurantiaca* | 7 | 1 |
| *Prevotella saccharolytica* | 8 | 0 |
| *Prevotella intermedia* locus 2 | 9 | 0 |
| *Capnocytophaga canimorsus* | 10 | 3 |
| *Porphyromonas gulae* | 11 | 4 |
| *Prevotella* sp. P5-125 | 12 | 2.1 |
| *Flavobacterium branchiophilum* | 13 | 1 |
| *Porphyromonas gingivalis* | 14 | 3 |
| *Prevotella intermedia* locus 2 | 15 | 4 |

TABLE 8 dCas13b-ADAR linker sequences used in this study for RNA editing in mammalian cells.

| Figure | linker |
|---|---|
| 50C | GSGGGGS |
| 50E | GS |
| 57B | GSGGGGS |
| 57C | GS |
| 57D | GS |
| 57E: GS | GS |
| 57E: GSGGGGS | GSGGGGS |
| 57E: (GGGS)3 | GGGGSGGGGSGGGGS |
| 57E: Rigid | EAAAK |
| 57E: (GGS)6 | GGSGGSGGSGGSGGSGGS |
| 57E: XTEN | SGSETPGTSESATPES |
| 51B | GS |
| 57F | GS |

TABLE 8-continued dCas13b-ADAR linker sequences used in this study for RNA editing in mammalian cells.

| Figure | linker |
|---|---|
| 51C | GS |
| 52B | GS |
| 52D | GS |
| 52E | GS |
| 51A: Δ984-1090, Δ1026-1090, Δ1053-1090 | GS |
| 51A: Δ1-125, Δ1-88, Δ1-72 | GSGGGGS |
| 53B | GS |
| 53C | GS |
| 53D | GS |
| 60A | GS |
| 60C | GS |
| 60D | GS |
| 61D | GS |
| 54A | GS |
| 62A | GS |
| 54B | GS |
| 62B | GS |
| 62C | GS |
| 63A | GS |
| 63B | GS |
| 54C | GS |
| 54D | GS |
| 54E | GS |
| 54F | GS |
| 66A | GS |
| 66A | GS |

TABLE 9

Disease information for disease-relevant mutations

| | Gene | Disease |
|---|---|---|
| Full length candidates | | |
| NM_000054.4(AVPR2):c.878G>A (p.Trp293Ter) | AVPR2 | Nephrogenic diabetes insipidus, X-linked |
| NM_000136.2(FANCC):c.1517G>A (p.Trp506Ter) | FANCC | Fanconi anemia, complementation group C |
| Additional simulated candiates | | |
| Candidate | | |
| NM 000206.2(IL2RG):c.710G>A (p.Trp237Ter) | IL2RG | X-linked severe combined immunodeficiency |
| NM_000132.3(F8):c.3144G>A (p.Trp1048Ter) | F8 | Hereditary factor VIII deficiency disease |
| NM_000527.4(LDLR):c.1449G>A (p.Trp483Ter) | LDLR | Familial hypercholesterolemia |
| NM_000071.2(CBS):c.162G>A (p.Trp54Ter) | CBS | Homocystinuria due to CBS deficiency |
| NM_000518.4(HBB):c.114G>A (p.Trp38Ter) | HBB | beta^0^ Thalassemia|beta Thalassemia |
| NM_000035.3(ALDOB):c.888G>A (p.Trp296Ter) | ALDOB | Hereditary fructosuria |
| NM_0040062(DMD):c.3747G>A (p.Trp1249Ter) | DMD | Duchenne muscular dystrophy |
| NM_005359.5(SMAD4):c.906G>A (p.Trp302Ter) | SMAD4 | Juvenile polyposis syndrome |
| NM_000059.3(BRCA2):c.582G>A (p.Trp194Ter) | BRCA2 | Familial cancer of breast|Breast-ovarian cancer, familial 2 |
| NM_000833.4(GRIN2A):c.3813G>A (p.Trp1271Ter) | GRIN2A | Epilepsy, focal, with speech disorder and with or without mental retardation |
| NM_002977.3(SCN9A):c.2691G>A (p.Trp897Ter) | SCN9A | Indifference to pain, congenital, autosomal recessive |
| NM_007375.3(TARDBP):c.943G>A (p.Ala315Thr) | TARDBP | Amyotrophic lateral sclerosis type 10 |
| NM_000492.3(CFTR):c.3846G>A (p.Trp1282Ter) | CFTR | Cystic fibrosis|Hereditary pancreatitis|not provided|ataluren response - Efficacy |

TABLE 9-continued

Disease information for disease-relevant mutations

| | Gene | Disease |
|---|---|---|
| NM_130838.1(UBE3A):c.2304G>A (p.Trp768Ter) | UBE3A | Angelman syndrome |
| NM_000543.4(SMPD1):c.168G>A (p.Trp56Ter) | SMPD1 | Niemann-Pick disease, type A |
| NM_206933.2(USH2A):c.9390G>A (p.Trp3130Ter) | USH2A | Usher syndrome, type 2A |
| NM_130799.2(MEN1):c.1269G>A (p.Trp423Ter) | MEN1 | Hereditary cancer-predisposing syndrome |
| NM_177965.3(C8orf37):c.555G>A (p.Trp185Ter) | C8orf37 | Retinitis pigmentosa 64 |
| NM_000249.3(MLH1):c.1998G>A (p.Trp666Ter) | MLH1 | Lynch syndrome |
| NM_000548.4(TSC2):c.2108G>A (p.Trp703Ter) | TSC2 | Tuberous sclerosis 2\|Tuberous sclerosis syndrome |
| NM_000267.3(NF1):c.7044G>A (p.Trp2348Ter) | NF1 | Neurofibromatosis, type 1 |
| NM_000179.2(MSH6):c.3020G>A (p.Trp1007Ter) | MSH6 | Lynch syndrome |
| NM_000344.3(SMN1):c.305G>A (p.Trp102Ter) | SMN1 | Spinal muscular atrophy, type II\|Kugelberg-Welander disease |
| NM_024577.3(SH3TC2):c.920G>A (p.Trp307Ter) | SH3TC2 | Charcot-Marie-Tooth disease, type 4C |
| NM_001369.2(DNAH5):c.8465G>A (p.Trp2822Ter) | DNAH5 | Primary ciliary dyskinesia |
| NM_004992.3(MECP2):c.311G>A (p.Trp104Ter) | MECP2 | Rett syndrome |
| NM_032119.3(ADGRV1):c.7406G>A (p.Trp2469Ter) | ADGRV1 | Usher syndrome, type 2C |
| NM 017651.4(AHI1):c.2174G>A (p.Trp725Ter) | AHI1 | Joubert syndrome 3 |
| NM_004562.2(PRKN):c.1358G>A (p.Trp453Ter) | PRKN | Parkinson disease 2 |
| NM_000090.3(COL3A1):c.3833G>A (p.Trpl278Ter) | COL3A1 | Ehlers-Danlos syndrome, type 4 |
| NM 007294.3(BRCA1):c.5511G>A (p.Trp1837Ter) | BRCA1 | Familial cancer of breast\|Breast-ovarian cancer, familial 1 |
| NM_000256.3(MYBPC3):c.3293G>A (p.Trp1098Ter) | MYBPC3 | Primary familial hypertrophic cardiomyopathy |
| NM_000038.5(APC):c.1262G>A (p.Trp421Ter) | APC | Familial adenomatous polyposis 1 |
| NM_001204.6(BMPR2):c.893G>A (p.W298*) | BMPR2 | Primary pulmonary hypertension |

TABLE 10

Key plasmids used in this study

| Plasmid name | Description |
|---|---|
| pAB0006 | CMV-Cluciferase-polyA EF1a-G-luciferase-polyA |
| pAB0040 | CMV-Cluciferase(STOP85)-polyA EF1a-G-luciferase-polyA |
| pAB0048 | pCDNA-ADAR2-N-terminal B12-HIV NES |
| pAB0050 | pAB0001-A02 (crRNA backbone) |
| pAB0051 | pAB0001-B06 (crRNA backbone) |
| pAB0052 | pAB0001-B11 (crRNA backbone) |
| pAB0053 | pAB0001-B12 (crRNA backbone) |
| pAB0014.B6 | EF1a-BsiWI-Cas13b6-NES-mapk |
| pAB0013.B11 | EF1a-BsiWI-Cas13b11-NES-HIV |
| pAB0013.B12 | EF1a-BsiWI-Cas13b12-NES-HIV |
| pAB0051 | pAB0001-B06 (crRNA backbone) |
| pAB0052 | pAB0001-B11 (crRNA backbone) |
| pAB0053 | pAB0001-B12 (crRNA backbone) |
| pAB0079 | pCDNA-ADAR1hu-EQmutant-N-terminal destination vector |
| pAB0085 | pCDNA-ADAR2 (E488Q)hu-EQmutant-N-terminal destination vector |
| pAB0095 | EF1a-BsiWI-Cas13-B12-NES-HIV, with double H HEPN mutant |
| pAB0114 | pCDNA-wtADAR2hu-EQmutant-N-terminal destination vector |
| pAB0120 | Luciferase ADAR guide optimal (guide 24 from wC0054) |
| pAB0122 | pAB0001-B12 NT guide for ADAR experiments |
| pAB0151 | pCDNA-ADAR2hu-EQmutant-N-terminal destination vector C-term delta 984-1090 |
| pAB0180 | T375G specificity mutant |
| pAB0181 | T375G Cas13b C-term delta 984-1090 |

TABLE 11

Guide/shRNA sequences used in this study for knockdown in mammalian cells

| Name | Spacer sequence | Interference Mechanism | Notes | First figure |
|---|---|---|---|---|
| Bacterial PFS guide | GCCAGCUUUCCGGGCA UUGGCUUCCAUC (SEQ ID NO: 155) | Cas13b | Used for all orthologs | |
| Cas13a-Gluc guide 1 | GCCAGCTTTCCGGGCAT TGGCTTCCATC (SEQ ID NO: 156) | Cas13a | Used for all Cas13a orthologs | FIG. 49B |
| Cas13a-Gluc guide 2 | ACCCAGGAATCTCAGG AATGTCGACGAT (SEQ ID NO: 157) | Cas13a | Used for all Cas13a orthologs | FIG. 49B |
| Cas13a-non-targeting guide (LacZ) | AGGGTTTTCCCAGTCAC GACGTTGTAAA (SEQ ID NO: 158) | Cas13a | Used for all Cas13a orthologs | FIG. 49B |
| Cas13b-Gluc guide 1.1 | GGGCATTGGCTTCCATC TCTTTGAGCACCT (SEQ ID NO: 159) | Cas13b | Used for orthologs 1-3, 6, 7, 10, 11, 12, 14, 15 | FIG. 49B |
| Cas13b-Gluc guide 1.2 | GUGCAGCCAGCUUUCC GGGCAUUGGCUUCC (SEQ ID NO: 160) | Cas13b | Used for ortholog 4 | FIG. 49B |
| Cas13b-Gluc guide 1.3 | GCAGCCAGCUUUCCGG GCAUUGGCUUCCAU (SEQ ID NO: 161) | Cas13b | Used for ortholog 5 | FIG. 49B |
| Cas13b-Gluc guide 1.4 | GGCUUCCAUCUCUUUG AGCACCUCCAGCGG (SEQ ID NO: 162) | Cas13b | Used for ortholog 8, 9 | FIG. 49B |
| Cas13b-Gluc guide 1.5 | GGAAUGUCGACGAUCG CCUCGCCUAUGCCG (SEQ ID NO: 163) | Cas13b | Used for ortholog 13 | FIG. 49B |
| Cas13b-Gluc guide 2.1 | GAAUGUCGACGAUCGC CUCGCCUAUGCCGC (SEQ ID NO: 164) | Cas13b | Used for orthologs 1-3, 6, 7, 10, 11, 14, 15 | FIG. 49B |
| Cas13b-Gluc guide 2.2 | GACCUGUGCGAUGAAC UGCUCCAUGGGCUC (SEQ ID NO: 165) | Cas13b | Used for ortholog 12 | FIG. 49B |
| Cas13b-Gluc guide 2.2 | GUGUGGCAGCGUCCUG GGAUGAACUUCUUC (SEQ ID NO: 166) | Cas13b | Used for ortholog 4 | FIG. 49B |
| Cas13b-Gluc guide 2.3 | GUGGCAGCGUCCUGGG AUGAACUUCUUCAU (SEQ ID NO: 167) | Cas13b | Used for ortholog 5 | FIG. 49B |
| Cas13b-Gluc guide 2.4 | GCUUCUUGCCGGGCAA CUUCCCGCGGUCAG (SEQ ID NO: 168) | Cas13b | Used for ortholog 8, 9 | FIG. 49B |
| Cas13b-Gluc guide 2.6 | GCAGGGUUUUCCCAGU CACGACGUUGUAAAA (SEQ ID NO: 169) | Cas13b | Used for ortholog 13 | FIG. 49B |
| Cas13b-non targeting guide | GCAGGGUUUUCCCAGU CACGACGUUGUAAAA (SEQ ID NO: 170) | Cas13b | Used for all orthologs | FIG. 49B |
| Cas13a-Gluc guide-RNASeq | ACCCAGGAAUCUCAGG AAUGUCGACGAU (SEQ ID NO: 171) | Cas13a | | FIG. 49E |

TABLE 11-continued

Guide/shRNA sequences used in this study for knockdown in mammalian cells

| Name | Spacer sequence | Interference Mechanism | Notes | First figure |
|---|---|---|---|---|
| shRNA-Gluc guide | CAGCTTTCCGGGCATTGGCTT (SEQ ID NO: 172) | shRNA | | FIG. 49F |
| Cas13b-Gluc guide-RNASeq | CCGCUGGAGGUGCUCAAAGAGAUGGAAGCC (SEQ ID NO: 173) | Cas13b | | FIG. 49F |
| Cas13a-Gluc-guide-1 | GCCAGCTTTCCGGGCATTGGCTTCCATC (SEQ ID NO: 174) | Cas13a | | FIG. 56A |
| Cas13a-Gluc-guide-2 | ACCCAGGAATCTCAGGAATGTCGACGAT (SEQ ID NO: 175) | Cas13a | | FIG. 56A |
| Cas13b-Gluc-opt-guide-1 | GGGCATTGGCTTCCATCTCTTTGAGCACCT (SEQ ID NO: 176) | Cas13b | | FIG. 56A |
| Cas13b-Gluc-opt-guide-2 | GAAUGUCGACGAUCGCCUCGCCUAUGCCGC (SEQ ID NO: 177) | Cas13b | | FIG. 56A |
| Cas13a KRAS guide 1 | CAAGGCACTCTTGCCTACGCCACCAGCT (SEQ ID NO: 178) | Cas13a | | FIG. 56B |
| Cas13a KRAS guide 2 | TCATATTCGTCCACAAAATGATTCTGAA (SEQ ID NO: 179) | Cas13a | | FIG. 56B |
| Cas13a KRAS guide 3 | ATTATTTATGGCAAATACACAAAGAAAG (SEQ ID NO: 180) | Cas13a | | FIG. 56B |
| Cas13a KRAS guide 4 | GAATATCTTCAAATGATTTAGTATTATT (SEQ ID NO: 181) | Cas13a | | FIG. 56B |
| Cas13a KRAS guide 5 | ACCATAGGTACATCTTCAGAGTCCTTAA (SEQ ID NO: 182) | Cas13a | | FIG. 56B |
| Cas13b KRAS guide 1 | GTCAAGGCACTCTTGCCTACGCCACCAGCT (SEQ ID NO: 183) | Cas13b | | FIG. 56B |
| Cas13b KRAS guide 2 | GATCATATTCGTCCACAAAATGATTCTGAA (SEQ ID NO: 184) | Cas13b | | FIG. 56B |
| Cas13b KRAS guide 3 | GTATTATTTATGGCAAATACACAAAGAAAG (SEQ ID NO: 185) | Cas13b | | FIG. 56B |
| Cas13b KRAS guide 4 | GTGAATATCTTCAAATGATTTAGTATTATT (SEQ ID NO: 186) | Cas13b | | FIG. 56B |
| Cas13b KRAS guide 5 | GGACCATAGGTACATCTTCAGAGTCCTTAA (SEQ ID NO: 187) | Cas13b | | FIG. 56B |
| shRNA KRAS guide 1 | aagagtgccttgacgatacagcCTCGAGgctgtatcgtcaaggcactctt (SEQ ID NO: 188) | shRNA | | FIG. 56B |

TABLE 11-continued

Guide/shRNA sequences used in this study for knockdown in mammalian cells

| Name | Spacer sequence | Interference Mechanism | Notes | First figure |
|---|---|---|---|---|
| shRNA KRAS guide 2 | aatcatttgtggacgaatatCTCGA Gatattcgtccacaaaatgatt (SEQ ID NO: 189) | shRNA | | FIG. 56B |
| shRNA KRAS guide 3 | aaataatactaaatcatttgaCTCGA Gtcaaatgatttagtattattt (SEQ ID NO: 190) | shRNA | | FIG. 56B |
| shRNA KRAS guide 4 | aataatactaaatcatttgaaCTCGA Gttcaaatgatttagtattatt (SEQ ID NO: 191) | shRNA | | FIG. 56B |
| shRNA KRAS guide 5 | aaggactctgaagatgtacctCTCG AGaggtacatcttcagagtcctt (SEQ ID NO: 192) | shRNA | | FIG. 56B |

TABLE 12

Guide sequences used for Gluc knockdown

| Name | Spacer sequence | Position | Notes | First FIG. |
|---|---|---|---|---|
| Gluc tiling guide 1 | GAGATCAGGGCAAAC AGAACTTTGACTCCC (SEQ ID NO: 193) | 2 | Note that the Cas13a spacers are truncated by two nucleotides at the 5' end | 49C |
| Gluc tiling guide 2 | GGATGCAGATCAGGGC AAACAGAACTTTGA (SEQ ID NO: 194) | 7 | Note that the Cas13a spacers are truncated by two nucleotides at the 5' end | 49C |
| Gluc tiling guide 3 | GCACAGCGATGCAGAT CAGGGCAAACAGAA (SEQ ID NO: 195) | 13 | Note that the Cas13a spacers are truncated by two nucleotides at the 5' end | 49C |
| Gluc tiling guide 4 | GCTCGGCCACAGCGAT GCAGATCAGGGCAA (SEQ ID NO: 196) | 19 | Note that the Cas13a spacers are truncated by two nucleotides at the 5' end | 49C |
| Gluc tiling guide 5 | GGGGCTTGGCCTCGGC CACAGCGATGCAGA (SEQ ID NO: 197) | 28 | Note that the Cas13a spacers are truncated by two nucleotides at the 5' end | 49C |
| Gluc tiling guide 6 | GTGGGCTTGGCCTCGG CCACAGCGATGCAG (SEQ ID NO: 198) | 29 | Note that the Cas13a spacers are truncated by two nucleotides at the 5' end | 49C |
| Gluc tiling guide 7 | GTCTCGGTGGGCTTGG CCTCGGCCACAGCG (SEQ ID NO: 199) | 35 | Note that the Cas13a spacers are truncated by two nucleotides at the 5' end | 49C |
| Gluc tiling guide 8 | GTTCGTTGTTCTCGGTG GGCTTGGCCTCGG (SEQ ID NO: 200) | 43 | Note that the Cas13a spacers are truncated by two nucleotides at the 5' end | 49C |
| Gluc tiling guide 9 | GGAAGTCTTCGTTGTT CTCGGTGGGCTTGG (SEQ ID NO: 201) | 49 | Note that the Cas13a spacers are truncated by two nucleotides at the 5' end | 49C |
| Gluc tiling guide 10 | GATGTTGAAGTCTTCG TTGTTCTCGGTGGG (SEQ ID NO: 202) | 54 | Note that the Cas13a spacers are truncated by two nucleotides at the 5' end | 49C |
| Gluc tiling guide 11 | GCGGCCACGATGTTGA AGTCTTCGTTGTTC (SEQ ID NO: 203) | 62 | Note that the Cas13a spacers are truncated by two nucleotides at the 5' end | 49C |
| Gluc tiling guide 12 | GTGGCCACGGCCACGA TGTTGAAGTCTTCG (SEQ ID NO: 204) | 68 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 13 | GGTTGCTGGCCACGGC CACGATGTTGAAGT (SEQ ID NO: 205) | 73 | Note that the Cas13a spacers are truncated by two nucleotides at the 5' end | 49C |
| Gluc tiling guide 14 | GTCGCGAAGTTGCTGG CCACGGCCACGATG (SEQ ID NO: 206) | 80 | Note that the Cas13a spacers are truncated by two nucleotides at the 5' end | 49C |
| Gluc tiling guide 15 | GCCGTGGTCGCGAAGT TGCTGGCCACGGCC (SEQ ID NO: 207) | 86 | Note that the Cas13a spacers are truncated by two nucleotides at the 5' end | 49C |
| Gluc tiling guide 16 | GCGAGATCCGTGGTCG CGAAGTTGCTGGCC (SEQ ID NO: 208) | 92 | Note that the Cas13a spacers are truncated by two nucleotides at the 5' end | 49C |
| Gluc tiling guide 17 | GCAGCATCGAGATCCG TGGTCGCGAAGTTG (SEQ ID NO: 209) | 98 | Note that the Cas13a spacers are truncated by two nucleotides at the 5' end | 49C |
| Gluc tiling guide 18 | GGGTCAGCATCGAGAT CCGTGGTCGCGAAG (SEQ ID NO: 210) | 101 | Note that the Cas13a spacers are truncated by two nucleotides at the 5' end | 49C |
| Gluc tiling guide 19 | GCTTCCCGCGGTCAGC ATCGAGATCCGTGG (SEQ ID NO: 211) | 109 | Note that the Cas13a spacers are truncated by two nucleotides at the 5' end | 49C |
| Gluc tiling guide 20 | GGGGCAACTTCCCGCG GTCAGCATCGAGAT (SEQ ID NO: 212) | 115 | Note that the Cas13a spacers are truncated by two nucleotides at the 5' end | 49C |
| Gluc tiling guide 21 | GTCTTGCCGGGCAACT TCCCGCGGTCAGCA (SEQ ID NO: 213) | 122 | Note that the Cas13a spacers are truncated by two nucleotides at the 5' end | 49C |
| Gluc tiling guide 22 | GGCAGCTTCTTGCCGG GCAACTTCCCGCGG (SEQ ID NO: 214) | 128 | Note that the Cas13a spacers are truncated by two nucleotides at the 5' end | 49C |
| Gluc tiling guide 23 | GCCAGCGGCAGCTTCT TGCCGGGCAACTTC (SEQ ID NO: 215) | 134 | Note that the Cas13a spacers are truncated by two nucleotides at the 5' end | 49C |
| Gluc tiling guide 24 | GCACCTCCAGCGGCAG CTTCTTGCCGGGCA (SEQ ID NO: 216) | 139 | Note that the Cas13a spacers are truncated by two nucleotides at the 5' end | 49C |
| Gluc tiling guide 25 | GCTTTGAGCACCTCCA GCGGCAGCTTCTTG (SEQ ID NO: 217) | 146 | Note that the Cas13a spacers are truncated by two nucleotides at the 5' end | 49C |
| Gluc tiling guide 26 | GCATCTCTTTGAGCAC CTCCAGCGGCAGCT (SEQ ID NO: 218) | 151 | Note that the Cas spacers are truncated by two nucleotides at the 5' end | 49C |
| Gluc tiling guide 27 | GTCCATCTCTTTGAGC ACCTCCAGCGGCAG (SEQ ID NO: 219) | 153 | Note that the Cas13a spacers are truncated by two nucleotides at the 5' end | 49C |
| Gluc tiling guide 28 | GGGCATTGGCTTCCAT CTCTTTGAGCACCT (SEQ ID NO: 220) | 163 | Note that the Cas13a spacers are truncated by two nucleotides at the 5' end | 49C |
| Gluc tiling guide 29 | GTCCGGGCATTGGCTT CCATCTCTTTGAGC (SEQ ID NO: 221) | 167 | Note that the Cas13a spacers are truncated by two nucleotides at the 5' end | 49C |
| Gluc tiling guide 30 | GGCCAGCTTTCCGGGC ATTGGCTTCCATCT (SEQ ID NO: 222) | 175 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 31 | GGGTGCAGCCAGCTTT CCGGGCATTGGCTT (SEQ ID NO: 223) | 181 | Note that the Cas13a spacers are truncated by two nucleotides at the 5' end | 49C |
| Gluc tiling guide 32 | GAGCCCTGGTGCAGC CAGCTTTCCGGGCA (SEQ ID NO: 224) | 188 | Note that the Cas13a spacers are truncated by two nucleotides at the 5' end | 49C |
| Gluc tiling guide 33 | GATCAGACAGCCCCTG GTGCAGCCAGCTTT (SEQ ID NO: 225) | 195 | Note that the Cas13a spacers are truncated by two nucleotides at the 5' end | 49C |
| Gluc tiling guide 34 | GGCAGATCAGACAGCC CCTGGTGCAGCCAG (SEQ ID NO: 226) | 199 | Note that the Cas13a spacers are truncated by two nucleotides at the 5' end | 49C |
| Gluc tiling guide 35 | GACAGGCAGATCAGAC AGCCCCTGGTGCAG (SEQ ID NO: 227) | 203 | Note that the Cas13a spacers are truncated by two nucleotides at the 5' end | 49C |
| Gluc tiling guide 36 | GTGATGTGGGACAGGC AGATCAGACAGCCC (SEQ ID NO: 228) | 212 | Note that the Cas13a spacers are truncated by two nucleotides at the 5' end | 49C |
| Gluc tiling guide 37 | GACTTGATGTGGGACA GGCAGATCAGACAG (SEQ ID NO: 229) | 215 | Note that the Cas spacers are truncated by two nucleotides at the 5' end | 49C |
| Gluc tiling guide 38 | GGGGCGTGCACTTGAT GTGGGACAGGCAGA (SEQ ID NO: 230) | 223 | Note that the Cas13a spacers are truncated by two nucleotides at the 5' end | 49C |
| Gluc tiling guide 39 | GCTTCATCTTGGGCGT GCACTTGATGTGGG (SEQ ID NO: 231) | 232 | Note that the Cas13a spacers are truncated by two nucleotides at the 5' end | 49C |
| Gluc tiling guide 40 | GTGAACTTCTTCATCTT GGGCGTGCACTTG (SEQ ID NO: 232) | 239 | Note that the Cas13a spacers are truncated by two nucleotides at the 5' end | 49C |
| Gluc tiling guide 41 | GGGATGAACTTCTTCA TCTTGGGCGTGCAC (SEQ ID NO: 233) | 242 | Note that the Cas13a spacers are truncated by two nucleotides at the 5' end | 49C |
| Gluc tiling guide 42 | GTGGGATGAACTTCTT CATCTTGGGCGTGC (SEQ ID NO: 234) | 244 | Note that the Cas13a spacers are truncated by two nucleotides at the 5' end | 49C |
| Gluc tiling guide 43 | GGGCAGCGTCCTGGGA TGAACTTCTTCATC (SEQ ID NO: 235) | 254 | Note that the Cas13a spacers are truncated by two nucleotides at the 5' end | 49C |
| Gluc tiling guide 44 | GGGTGTGGCAGCGTCC TGGGATGAACTTCT (SEQ ID NO: 236) | 259 | Note that the Cas13a spacers are truncated by two nucleotides at the 5' end | 49C |
| Gluc tiling guide 45 | GTTCGTAGGTGTGGCA GCGTCCTGGGATGA (SEQ ID NO: 237) | 265 | Note that the Cas13a spacers are truncated by two nucleotides at the 5' end | 49C |
| Gluc tiling guide 46 | GCGCCTTCGTAGGTGT GGCAGCGTCCTGGG (SEQ ID NO: 238) | 269 | Note that the Cas13a spacers are truncated by two nucleotides at the 5' end | 49C |
| Gluc tiling guide 47 | GTCTTTGTCGCCTTCGT AGGTGTGGCAGCG (SEQ ID NO: 239) | 276 | Note that the Cas13a spacers are truncated by two nucleotides at the 5' end | 49C |
| Gluc tiling guide 48 | GCTTTGTCGCCTTCGTA GGTGTGGCAGCGT (SEQ ID NO: 240) | 275 | Note that the Cas13a spacers are truncated by two nucleotides at the 5' end | 49C |
| Gluc tiling guide 49 | GTGCCGCCCTGTGCGG ACTCTTTGTCGCCT (SEQ ID NO: 241) | 293 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 50 | GTATGCCGCCCTGTGC GGACTCTTTGTCGC (SEQ ID NO: 242) | 295 | Note that the Cas13a spacers are truncated by two nucleotides at the 5' end | 49C |
| Gluc tiling guide 51 | GCCTCGCCTATGCCGC CCTGTGCGGACTCT (SEQ ID NO: 243) | 302 | Note that the Cas13a spacers are truncated by two nucleotides at the 5' end | 49C |
| Gluc tiling guide 52 | GGATCGCCTCGCCTAT GCCGCCCTGTGCGG (SEQ ID NO: 244) | 307 | Note that the Cas13a spacers are truncated by two nucleotides at the 5' end | 49C |
| Gluc tiling guide 53 | GATGTCGACGATCGCC TCGCCTATGCCGCC (SEQ ID NO: 245) | 315 | Note that the Cas13a spacers are truncated by two nucleotides at the 5' end | 49C |
| Gluc tiling guide 54 | GCAGGAATGTCGACGA TCGCCTCGCCTATG (SEQ ID NO: 246) | 320 | Note that the Cas13a spacers are truncated by two nucleotides at the 5' end | 49C |
| Gluc tiling guide 55 | GAATCTCAGGAATGTC GACGATCGCCTCGC (SEQ ID NO: 247) | 325 | Note that the Cas13a spacers are truncated by two nucleotides at the 5' end | 49C |
| Gluc tiling guide 56 | GCCCAGGAATCTCAGG AATGTCGACGATCG (SEQ ID NO: 248) | 331 | Note that the Cas13a spacers are truncated by two nucleotides at the 5' end | 49C |
| Gluc tiling guide 57 | GCCTTGAACCCAGGAA TCTCAGGAATGTCG (SEQ ID NO: 249) | 338 | Note that the Cas13a spacers are truncated by two nucleotides at the 5' end | 49C |
| Gluc tiling guide 58 | GCCAAGTCCTTGAACC CAGGAATCTCAGGA (SEQ ID NO: 250) | 344 | Note that the Cas13a spacers are truncated by two nucleotides at the 5' end | 49C |
| Gluc tiling guide 59 | GTGGGCTCCAAGTCCT TGAACCCAGGAATC (SEQ ID NO: 251) | 350 | Note that the Cas13a spacers are truncated by two nucleotides at the 5' end | 49C |
| Gluc tiling guide 60 | GCCATGGGCTCCAAGT CCTTGAACCCAGGA (SEQ ID NO: 252) | 353 | Note that the Cas13a spacers are truncated by two nucleotides at the 5' end | 49C |
| Gluc tiling guide 61 | GGAACTGCTCCATGGG CTCCAAGTCCTTGA (SEQ ID NO: 253) | 361 | Note that the Cas13a spacers are truncated by two nucleotides at the 5' end | 49C |
| Gluc tiling guide 62 | GTGCGATGAACTGCTC CATGGGCTCCAAGT (SEQ ID NO: 254) | 367 | Note that the Cas13a spacers are truncated by two nucleotides at the 5' end | 49C |
| Gluc tiling guide 63 | GGACCTGTGCGATGAA CTGCTCCATGGGCT (SEQ ID NO: 255) | 373 | Note that the Cas13a spacers are truncated by two nucleotides at the 5' end | 49C |
| Gluc tiling guide 64 | GACAGATCGACCTGTG CGATGAACTGCTCC (SEQ ID NO: 256) | 380 | Note that the Cas13a spacers are truncated by two nucleotides at the 5' end | 49C |
| Gluc tiling guide 65 | GACACACAGATCGACC TGTGCGATGAACTG (SEQ ID NO: 257) | 384 | Note that the Cas13a spacers are truncated by two nucleotides at the 5' end | 49C |
| Gluc tiling guide 66 | GTGCAGTCCACACACA GATCGACCTGTGCG (SEQ ID NO: 258) | 392 | Note that the Cas13a spacers are truncated by two nucleotides at the 5' end | 49C |
| Gluc tiling guide 67 | GCCAGTTGTGCAGTCC ACACACAGATCGAC (SEQ ID NO: 259) | 399 | Note that the Cas13a spacers are truncated by two nucleotides at the 5' end | 49C |
| Gluc tiling guide 68 | GGGCAGCCAGTTGTGC AGTCCACACACAGA (SEQ ID NO: 260) | 404 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 69 | GTTTGAGGCAGCCAGT TGTGCAGTCCACAC (SEQ ID NO: 261) | 409 | Note that the Cas13a spacers are truncated by two nucleotides at the 5' end | 49C |
| Gluc tiling guide 70 | GAAGCCCTTTGAGGCA GCCAGTTGTGCAGT (SEQ ID NO: 262) | 415 | Note that the Cas13a spacers are truncated by two nucleotides at the 5' end | 49C |
| Gluc tiling guide 71 | GCACGTTGGCAAGCCC TTTGAGGCAGCCAG (SEQ ID NO: 263) | 424 | Note that the Cas13a spacers are truncated by two nucleotides at the 5' end | 49C |
| Gluc tiling guide 72 | GACTGCACGTTGGCAA GCCCTTTGAGGCAG (SEQ ID NO: 264) | 428 | Note that the Cas13a spacers are truncated by two nucleotides at the 5' end | 49C |
| Gluc tiling guide 73 | GGGTCAGAACACTGCA CGTTGGCAAGCCCT (SEQ ID NO: 265) | 437 | Note that the Cas13a spacers are truncated by two nucleotides at the 5' end | 49C |
| Gluc tiling guide 74 | GCAGGTCAGAACACTG CACGTTGGCAAGCC (SEQ ID NO: 266) | 439 | Note that the Cas13a spacers are truncated by two nucleotides at the 5' end | 49C |
| Gluc tiling guide 75 | GAGCAGGTCAGAACAC TGCACGTTGGCAAG (SEQ ID NO: 267) | 441 | Note that the Cas13a spacers are truncated by two nucleotides at the 5' end | 49C |
| Gluc tiling guide 76 | GGCCACTTCTTGAGCA GGTCAGAACACTGC (SEQ ID NO: 268) | 452 | Note that the Cas13a spacers are truncated by two nucleotides at the 5' end | 49C |
| Gluc tiling guide 77 | GCGGCAGCCACTTCTT GAGCAGGTCAGAAC (SEQ ID NO: 269) | 457 | Note that the Cas13a spacers are truncated by two nucleotides at the 5' end | 49C |
| Gluc tiling guide 78 | GTGCGGCAGCCACTTC TTGAGCAGGTCAGA (SEQ ID NO: 270) | 459 | Note that the Cas13a spacers are truncated by two nucleotides at the 5' end | 49C |
| Gluc tiling guide 79 | GAGCGTTGCGGCAGCC ACTTCTTGAGCAGG (SEQ ID NO: 271) | 464 | Note that the Cas13a spacers are truncated by two nucleotides at the 5' end | 49C |
| Gluc tiling guide 80 | GAAAGGTCGCACAGCG TTGCGGCAGCCACT (SEQ ID NO: 272) | 475 | Note that the Cas13a spacers are truncated by two nucleotides at the 5' end | 49C |
| Gluc tiling guide 81 | GCTGGCAAAGGTCGCA CAGCGTTGCGGCAG (SEQ ID NO: 273) | 480 | Note that the Cas13a spacers are truncated by two nucleotides at the 5' end | 49C |
| Gluc tiling guide 82 | GGGCAAAGGTCGCACA GCGTTGCGGCAGCC (SEQ ID NO: 274) | 478 | Note that the Cas13a spacers are truncated by two nucleotides at the 5' end | 49C |
| Gluc tiling guide 83 | GTGGATCTTGCTGGCA AAGGTCGCACAGCG (SEQ ID NO: 275) | 489 | Note that the Cas13a spacers are truncated by two nucleotides at the 5' end | 49C |
| Gluc tiling guide 84 | GCACCTGGCCCTGGAT CTTGCTGGCAAAGG (SEQ ID NO: 276) | 499 | Note that the Cas13a spacers are truncated by two nucleotides at the 5' end | 49C |
| Gluc tiling guide 85 | GTGGCCCTGGATCTTG CTGGCAAAGGTCGC (SEQ ID NO: 277) | 495 | Note that the Cas13a spacers are truncated by two nucleotides at the 5' end | 49C |
| Gluc tiling guide 86 | GTGATCTTGTCCACCT GGCCCTGGATCTTG (SEQ ID NO: 278) | 509 | Note that the Cas13a spacers are truncated by two nucleotides at the 5' end | 49C |
| Gluc tiling guide 87 | GCCCCTTGATCTTGTCC ACCTGGCCCTGGA (SEQ ID NO: 279) | 514 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 88 | GCCCTTGATCTTGTCC ACCTGGCCCTGGAT (SEQ ID NO: 280) | 513 | Note that the Cas13a spacers are truncated by two nucleotides at the 5' end | 49C |
| Gluc tiling guide 89 | GCCTTGATCTTGTCCA CCTGGCCCTGGATC (SEQ ID NO: 281) | 512 | Note that the Cas13a spacers are truncated by two nucleotides at the 5' end | 49C |
| Gluc tiling guide 90 | GGCAAAGGTCGCACAG CGTTGCGGCAGCCA (SEQ ID NO: 282) | 477 | Note that the Cas13a spacers are truncated by two nucleotides at the 5' end | 49C |
| Gluc tiling guide 91 | GCAAAGGTCGCACAGC GTTGCGGCAGCCAC (SEQ ID NO: 283) | 476 | Note that the Cas13a spacers are truncated by two nucleotides at the 5' end | 49C |
| Gluc tiling guide 92 | GAAGGTCGCACAGCGT TGCGGCAGCCACTT (SEQ ID NO: 284) | 474 | Note that the Cas13a spacers are truncated by two nucleotides at the 5' end | 49C |
| Gluc tiling guide 93 | GAGGTCGCACAGCGTT GCGGCAGCCACTTC (SEQ ID NO: 285) | 473 | Note that the Cas13a spacers are truncated by two nucleotides at the 5' end | 49C |
| Non-targeting guide 1 | GGTAATGCCTGGCTTG TCGACGCATAGTCTG (SEQ ID NO: 286) | N/A | Note that the Cas13a spacers are truncated by two nucleotides at the 5' end | 49C |
| Non-targeting guide 2 | GGGAACCTTGGCCGTT ATAAAGTCTGACCAG (SEQ ID NO: 287) | N/A | Note that the Cas13a spacers are truncated by two nucleotides at the 5' end | 49C |
| Non-targeting guide 3 | GGAGGGTGAGAATTTA GAACCAAGATTGTTG (SEQ ID NO: 288) | N/A | Note that the Cas13a spacers are truncated by two nucleotides at the 5' end | 49C |

TABLE 13

Guide sequences used for Cluc knockdown

| Name | Spacer sequence | Position | Notes | First FIG. |
|---|---|---|---|---|
| Cluc tiling guide 1 | GAGTCCTGGCAATGA ACAGTGGCGCAGTAG (SEQ ID NO: 289) | 32 | Note that the Cas13a spacers are truncated by two nucleotides at the 5' end | 49D |
| Cluc tiling guide 2 | GGGTGCCACAGCTGC TATCAATACATTCTC (SEQ ID NO: 290) | 118 | Note that the Cas13a spacers are truncated by two nucleotides at the 5' end | 49D |
| Cluc tiling guide 3 | GTTACATACTGACAC ATTCGGCAACATGTT (SEQ ID NO: 291) | 197 | Note that the Cas13a spacers are truncated by two nucleotides at the 5' end | 49D |
| Cluc tiling guide 4 | GTATGTACCAGGTTCC TGGAACTGGAATCT (SEQ ID NO: 292) | 276 | Note that the Cas13a spacers are truncated by two nucleotides at the 5' end | 49D |
| Cluc tiling guide 5 | GCCTTGGTTCCATCCA GGTTCTCCAGGGTG (SEQ ID NO: 293) | 350 | Note that the Cas13a spacers are truncated by two nucleotides at the 5' end | 49D |
| Cluc tiling guide 6 | GCAGTGATGGGATTC TCAGTAGCTTGAGCG (SEQ ID NO: 294) | 431 | Note that the Cas13a spacers are truncated by two nucleotides at the 5' end | 49D |
| Cluc tiling guide 7 | GAGCCTGGCATCTCA ACAACAGCGATGGTG (SEQ ID NO: 295) | 512 | Note that the Cas13a spacers are truncated by two nucleotides at the 5' end | 49D |

TABLE 13-continued

Guide sequences used for Cluc knockdown

| Name | Spacer sequence | Position | Notes | First FIG. |
|---|---|---|---|---|
| Cluc tiling guide 8 | GTGTCTGGGGCGATTC TTACAGATCTTCCT (SEQ ID NO: 296) | 593 | Note that the Cas13a spacers are truncated by two nucleotides at the 5' end | 49D |
| Cluc tiling guide 9 | GCTGGATCTGAAGTG AAGTCTGTATCTTCC (SEQ ID NO: 297) | 671 | Note that the Cas13a spacers are truncated by two nucleotides at the 5' end | 49D |
| Cluc tiling guide 10 | GGCAACGTCATCAGG ATTTCCATAGAGTGG (SEQ ID NO: 298) | 747 | Note that the Cas13a spacers are truncated by two nucleotides at the 5' end | 49D |
| Cluc tiling guide 11 | GAGGCGCAGGAGATG GTGTAGTAGTAGAAG (SEQ ID NO: 299) | 830 | Note that the Cas13a spacers are truncated by two nucleotides at the 5' end | 49D |
| Cluc tiling guide 13 | GAGGGACCCTGGAAT TGGTATCTTGCTTTG (SEQ ID NO: 300) | 986 | Note that the Cas13a spacers are truncated by two nucleotides at the 5' end | 49D |
| Cluc tiling guide 14 | GGTAAGAGTCAACAT TCCTGTGTGAAACCT (SEQ ID NO: 301) | 1066 | Note that the Cas13a spacers are truncated by two nucleotides at the 5' end | 49D |
| Cluc tiling guide 15 | GACCAGAATCTGTTTT CCATCAACAATGAG (SEQ ID NO: 302) | 1143 | Note that the Cas13a spacers are truncated by two nucleotides at the 5' end | 49D |
| Cluc tiling guide 16 | GATGGCTGTAGTCAG TATGTCACCATCTTG (SEQ ID NO: 303) | 1227 | Note that the Cas13a spacers are truncated by two nucleotides at the 5' end | 49D |
| Cluc tiling guide 17 | GTACCATCGAATGGA TCTCTAATATGTACG (SEQ ID NO: 304) | 1304 | Note that the Cas13a spacers are truncated by two nucleotides at the 5' end | 49D |
| Cluc tiling guide 18 | GAGATCACAGGCTCC TTCAGCATCAAAAGA (SEQ ID NO: 305) | 1380 | Note that the Cas13a spacers are truncated by two nucleotides at the 5' end | 49D |
| Cluc tiling guide 19 | GCTTTGACCGGCGAA GAGACTATTGCAGAG (SEQ ID NO: 306) | 1461 | Note that the Cas13a spacers are truncated by two nucleotides at the 5' end | 49D |
| Cluc tiling guide 20 | GCCCCTCAGGCAATA CTCGTACATGCATCG (SEQ ID NO: 307) | 1539 | Note that the Cas13a spacers are truncated by two nucleotides at the 5' end | 49D |
| Cluc tiling guide 21 | GCTGGTACTTCTAGGG TGTCTCCATGCTTT (SEQ ID NO: 308) | 1619 | Note that the Cas13a spacers are truncated by two nucleotides at the 5' end | 49D |
| Non-targeting guide 1 | GGTAATGCCTGGCTTG TCGACGCATAGTCTG (SEQ ID NO: 309) | N/A | Note that the Cas13a spacers are truncated by two nucleotides at the 5' end | 49D |
| Non-targeting guide 2 | GGGAACCTTGGCCGT TATAAAGTCTGACCAG (SEQ ID NO: 310) | N/A | Note that the Cas13a spacers are truncated by two nucleotides at the 5' end | 49D |
| Non-targeting guide 3 | GGAGGGTGAGAATTT AGAACCAAGATTGTTG (SEQ ID NO: 311) | N/A | Note that the Cas13a spacers are truncated by two nucleotides at the 5' end | 49D |

TABLE 14

Guide sequences used in this study for RNA editing in mammalian cells.
Mismatched base flips are capitalized

| Name | Spacer sequence | Notes | First FIG. |
|---|---|---|---|
| Tiling 30 nt 30 mismatch distance | gCatcctgcggcctctactctgcattcaatt (SEQ ID NO: 312) | Has a 5' G for U6 expression | 50C |
| Tiling 30 nt 28 mismatch distance | gacCatcctgcggcctctactctgcattcaa (SEQ ID NO: 313) | Has a 5' G for U6 expression | 50C |
| Tiling 30 nt 26 mismatch distance | gaaacCatcctgcggcctctactctgcattc (SEQ ID NO: 314) | Has a 5' G for U6 expression | 50C |
| Tiling 30 nt 24 mismatch distance | gctaaacCatcctgcggcctctactctgcat (SEQ ID NO: 315) | Has a 5' G for U6 expression | 50C |
| Tiling 30 nt 22 mismatch distance | gttctaaacCatcctgcggcctctactctgc (SEQ ID NO: 316) | Has a 5' G for U6 expression | 50C |
| Tiling 30 nt 20 mismatch distance | gtgttctaaacCatcctgcggcctctactct (SEQ ID NO: 317) | Has a 5' G for U6 expression | 50C |
| Tiling 30 nt 18 mismatch distance | gaatgttctaaacCatcctgcggcctctact (SEQ ID NO: 318) | Has a 5' G for U6 expression | 50C |
| Tiling 30 nt 16 mismatch distance | gagaatgttctaaacCatcctgcggcctcta (SEQ ID NO: 319) | Has a 5' G for U6 expression | 50C |
| Tiling 30 nt 14 mismatch distance | gatagaatgttctaaacCatcctgcggcctc (SEQ ID NO: 320) | Has a 5' G for U6 expression | 50C |
| Tiling 30 nt 12 mismatch distance | gccatagaatgttctaaacCatcctgcggcc (SEQ ID NO: 321) | Has a 5' G for U6 expression | 50C |
| Tiling 30 nt 10 mismatch distance | gttccatagaatgttctaaacCatcctgcgg (SEQ ID NO: 322) | Has a 5' G for U6 expression | 50C |
| Tiling 30 nt 8 mismatch distance | gctttccatagaatgttctaaacCatcctgc (SEQ ID NO: 323) | Has a 5' G for U6 expression | 50C |
| Tiling 30 nt 6 mismatch distance | gctctttccatagaatgttctaaacCatcct (SEQ ID NO: 324) | Has a 5' G for U6 expression | 50C |
| Tiling 30 nt 4 mismatch distance | gatctctttccatagaatgttctaaacCatc (SEQ ID NO: 325) | Has a 5' G for U6 expression | 50C |
| Tiling 30 nt 2 mismatch distance | ggaatctctttccatagaatgttctaaacCa (SEQ ID NO: 326) | Has a 5' G for U6 expression | 50C |
| Tiling 50 nt 50 mismatch distance | gCatcctgcggcctctactctgcattcaatt acatactgacacattcggca (SEQ ID NO: 327) | Has a 5' G for U6 expression | 50C |
| Tiling 50 nt 48 mismatch distance | gacCatcctgcggcctctactctgcattca attacatactgacacattcgg (SEQ ID NO: 328) | Has a 5' G for U6 expression | 50C |
| Tiling 50 nt 46 mismatch distance | gaaacCatcctgcggcctctactctgcatt caattacatactgacacattc (SEQ ID NO: 329) | Has a 5' G for U6 expression | 50C |

TABLE 14-continued

Guide sequences used in this study for RNA editing in mammalian cells.
Mismatched base flips are capitalized

| Name | Spacer sequence | Notes | First FIG. |
|---|---|---|---|
| Tiling 50 nt 44 mismatch distance | gctaaacCatcctgcggcctctactctgca ttcaattacatactgacacat (SEQ ID NO: 330) | Has a 5' G for U6 expression | 50C |
| Tiling 50 nt 42 mismatch distance | gttctaaacCatcctgcggcctctactctg cattcaattacatactgacac (SEQ ID NO: 331) | Has a 5' G for U6 expression | 50C |
| Tiling 50 nt 40 mismatch distance | gtgttctaaacCatcctgcggcctctactct gcattcaattacatactgac (SEQ ID NO: 332) | Has a 5' G for U6 expression | 50C |
| Tiling 50 nt 38 mismatch distance | gaatgttctaaacCatcctgcggcctctac tctgcattcaattacatactg (SEQ ID NO: 333) | Has a 5' G for U6 expression | 50C |
| Tiling 50 nt 36 mismatch distance | gagaatgttctaaacCatcctgcggcctct actctgcattcaattacatac (SEQ ID NO: 334) | Has a 5' G for U6 expression | 50C |
| Tiling 50 nt 34 mismatch distance | gatagaatgttctaaacCatcctgcggcct ctactctgcattcaattacat (SEQ ID NO: 335) | Has a 5' G for U6 expression | 50C |
| Tiling 50 nt 32 mismatch distance | gccatagaatgttctaaacCatcctgcgg cctctactctgcattcaattac (SEQ ID NO: 336) | Has a 5' G for U6 expression | 50C |
| Tiling 50 nt 30 mismatch distance | gttccatagaatgttctaaacCatcctgcg gcctctactctgcattcaatt (SEQ ID NO: 337) | Has a 5' G for U6 expression | 50C |
| Tiling 50 nt 28 mismatch distance | gctttccatagaatgttctaaacCatcctgc ggcctctactctgcattcaa (SEQ ID NO: 338) | Has a 5' G for U6 expression | 50C |
| Tiling 50 nt 26 mismatch distance | gctctttccatagaatgttctaaacCatcct gcggcctctactctgcattc (SEQ ID NO: 339) | Has a 5' G for U6 expression | 50C |
| Tiling 50 nt 24 mismatch distance | gatctctttccatagaatgttctaaacCatc ctgcggcctctactctgcat (SEQ ID NO: 340) | Has a 5' G for U6 expression | 50C |
| Tiling 50 nt 22 mismatch distance | ggaatctctttccatagaatgttctaaacCa tcctgcggcctctactctgc (SEQ ID NO: 341) | Has a 5' G for U6 expression | 50C |
| Tiling 50 nt 20 mismatch distance | gtggaatctctttccatagaatgttctaaac Catcctgcggcctctactct (SEQ ID NO: 342) | Has a 5' G for U6 expression | 50C |
| Tiling 50 nt 18 mismatch distance | gactggaatctctttccatagaatgttctaaa cCatcctgcggcctctact (SEQ ID NO: 343) | Has a 5' G for U6 expression | 50C |
| Tiling 50 nt 16 mismatch distance | ggaactggaatctctttccatagaatgttct aaacCatcctgcggcctcta (SEQ ID NO: 344) | Has a 5' G for U6 expression | 50C |
| Tiling 50 nt 14 mismatch distance | gtggaactggaatctctttccatagaatgtt ctaaacCatcctgcggcctc (SEQ ID NO: 345) | Has a 5' G for U6 expression | 50C |
| Tiling 50 nt 12 mismatch distance | gcctggaactggaatctctttccatagaatg ttctaaacCatcctgcggcc (SEQ ID NO: 346) | Has a 5' G for U6 expression | 50C |
| Tiling 50 nt 10 mismatch distance | gttcctggaactggaatctctttccatagaa tgttctaaacCatcctgcgg (SEQ ID NO: 347) | Has a 5' G for U6 expression | 50C |

TABLE 14-continued

Guide sequences used in this study for RNA editing in mammalian cells.
Mismatched base flips are capitalized

| Name | Spacer sequence | Notes | First FIG. |
|---|---|---|---|
| Tiling 50 nt 8 mismatch distance | gggttcctggaactggaatctctttccatag aatgttctaaacCatcctgc (SEQ ID NO: 348) | Has a 5' G for U6 expression | 50C |
| Tiling 50 nt 6 mismatch distance | gcaggttcctggaactggaatctctttccat agaatgttctaaacCatcct (SEQ ID NO: 349) | Has a 5' G for U6 expression | 50C |
| Tiling 50 nt 4 mismatch distance | gaccaggttcctggaactggaatctctttcc atagaatgttctaaacCatc (SEQ ID NO: 350) | Has a 5' G for U6 expression | 50C |
| Tiling 50 nt 2 mismatch distance | ggtaccaggttcctggaactggaatctcttt ccatagaatgttctaaacCa (SEQ ID NO: 351) | Has a 5' G for U6 expression | 50C |
| Tiling 70 nt 70 mismatch distance | gCatcctgcggcctctactctgcattcaatt acatactgacacattcggcaacatgtttttc ctggtttat (SEQ ID NO: 352) | Has a 5' G for U6 expression | 50C |
| Tiling 70 nt 68 mismatch distance | gacCatcctgcggcctctactctgcattca attacatactgacacattcggcaacatgtttt tcctggttt (SEQ ID NO: 353) | Has a 5' G for U6 expression | 50C |
| Tiling 70 nt 66 mismatch distance | gaaacCatcctgcggcctctactctgcatt caattacatactgacacattcggcaacatgt ttttcctggt (SEQ ID NO: 354) | Has a 5' G for U6 expression | 50C |
| Tiling 70 nt 64 mismatch distance | gctaaacCatcctgcggcctctactctgca ttcaattacatactgacacattcggcaacat gttttcctg (SEQ ID NO: 355) | Has a 5' G for U6 expression | 50C |
| Tiling 70 nt 62 mismatch distance | gttctaaacCatcctgcggcctctactctg cattcaattacatactgacacattcggcaac atgttttcc (SEQ ID NO: 356) | Has a 5' G for U6 expression | 50C |
| Tiling 70 nt 60 mismatch distance | gtgttctaaacCatcctgcggcctctactct gcattcaattacatactgacacattcggcaa catgttttt (SEQ ID NO: 357) | Has a 5' G for U6 expression | 50C |
| Tiling 70 nt 58 mismatch distance | gaatgttctaaacCatcctgcggcctctac tctgcattcaattacatactgacacattcgg caacatgttt (SEQ ID NO: 358) | Has a 5' G for U6 expression | 50C |
| Tiling 70 nt 56 mismatch distance | gagaatgttctaaacCatcctgcggcctct actctgcattcaattacatactgacacattc ggcaacatgt (SEQ ID NO: 359) | Has a 5' G for U6 expression | 50C |
| Tiling 70 nt 54 mismatch distance | gatagaatgttctaaacCatcctgcggcct ctactctgcattcaattacatactgacacatt cggcaacat (SEQ ID NO: 360) | Has a 5' G for U6 expression | 50C |
| Tiling 70 nt 52 mismatch distance | gccatagaatgttctaaacCatcctgcgg cctctactctgcattcaattacatactgacac attcggcaac (SEQ ID NO: 361) | Has a 5' G for U6 expression | 50C |
| Tiling 70 nt 50 mismatch distance | gttccatagaatgttctaaacCatcctgcg gcctctactctgcattcaattacatactgac acattcggca (SEQ ID NO: 362) | Has a 5' G for U6 expression | 50C |

TABLE 14-continued

Guide sequences used in this study for RNA editing in mammalian cells.
Mismatched base flips are capitalized

| Name | Spacer sequence | Notes | First FIG. |
|---|---|---|---|
| Tiling 70 nt 48 mismatch distance | gctttccatagaatgttctaaacCatcctgc ggcctctactctgcattcaattacatactga cacattcgg (SEQ ID NO: 363) | Has a 5' G for U6 expression | 50C |
| Tiling 70 nt 46 mismatch distance | gctctttccatagaatgttctaaacCatcct gcggcctctactctgcattcaattacatact gacacattc (SEQ ID NO: 364) | Has a 5' G for U6 expression | 50C |
| Tiling 70 nt 44 mismatch distance | gatctctttccatagaatgttctaaacCatc ctgcggcctctactctgcattcaattacata ctgacacat (SEQ ID NO: 365) | Has a 5' G for U6 expression | 50C |
| Tiling 70 nt 42 mismatch distance | ggaatctctttccatagaatgttctaaacCa tcctgcggcctctactctgcattcaattacat actgacac (SEQ ID NO: 366) | Has a 5' G for U6 expression | 50C |
| Tiling 70 nt 40 mismatch distance | gtggaatctctttccatagaatgttctaaac Catcctgcggcctctactctgcattcaatta catactgac (SEQ ID NO: 367) | Has a 5' G for U6 expression | 50C |
| Tiling 70 nt 38 mismatch distance | gactggaatctctttccatagaatgttctaaa cCatcctgcggcctctactctgcattcaatt acatactg (SEQ ID NO: 368) | Has a 5' G for U6 expression | 50C |
| Tiling 70 nt 36 mismatch distance | ggaactggaatctctttccatagaatgttct aaacCatcctgcggcctctactctgcattc aattacatac (SEQ ID NO: 369) | Has a 5' G for U6 expression | 50C |
| Tiling 70 nt 34 mismatch distance | gtggaactggaatctctttccatagaatgtt ctaaacCatcctgcggcctctactctgcat tcaattacat (SEQ ID NO: 370) | Has a 5' G for U6 expression | 50C |
| Tiling 70 nt 32 mismatch distance | gcctggaactggaatctctttccatagaatg ttctaaacCatcctgcggcctctactctgc attcaattac (SEQ ID NO: 371) | Has a 5' G for U6 expression | 50C |
| Tiling 70 nt 30 mismatch distance | gttcctggaactggaatctctttccatagaa tgttctaaacCatcctgcggcctctactctg cattcaatt (SEQ ID NO: 372) | Has a 5' G for U6 expression | 50C |
| Tiling 70 nt 28 mismatch distance | gggttcctggaactggaatctctttccatag aatgttctaaacCatcctgcggcctctact ctgcattcaa (SEQ ID NO: 373) | Has a 5' G for U6 expression | 50C |
| Tiling 70 nt 26 mismatch distance | gcaggttcctggaactggaatctctttccat agaatgttctaaacCatcctgcggcctcta ctctgcattc (SEQ ID NO: 374) | Has a 5' G for U6 expression | 50C |
| Tiling 70 nt 24 mismatch distance | gaccaggttcctggaactggaatctctttcc atagaatgttctaaacCatcctgcggcctc tactctgcat (SEQ ID NO: 375) | Has a 5' G for U6 expression | 50C |
| Tiling 70 nt 22 mismatch distance | ggtaccaggttcctggaactggaatctcttt ccatagaatgttctaaacCatcctgcggcc tctactctgc (SEQ ID NO: 376) | Has a 5' G for U6 expression | 50C |
| Tiling 70 nt 20 mismatch distance | gatgtaccaggttcctggaactggaatctc tttccatagaatgttctaaacCatcctgcgg cctctactct (SEQ ID NO: 377) | Has a 5' G for U6 expression | 50C |

TABLE 14-continued

Guide sequences used in this study for RNA editing in mammalian cells.
Mismatched base flips are capitalized

| Name | Spacer sequence | Notes | First FIG. |
|---|---|---|---|
| Tiling 70 nt 18 mismatch distance | ggtatgtaccaggttcctggaactggaatc tctttccatagaatgttctaaacCatcctgc ggcctctact (SEQ ID NO: 378) | Has a 5' G for U6 expression | 50C |
| Tiling 70 nt 16 mismatch distance | gacgtatgtaccaggttcctggaactggaa tctattccatagaatgttctaaacCatcctg cggcctcta (SEQ ID NO: 379) | Has a 5' G for U6 expression | 50C |
| Tiling 70 nt 14 mismatch distance | gacacgtatgtaccaggttcctggaactgg aatctctttccatagaatgttctaaacCatc ctgcggcctc (SEQ ID NO: 380) | Has a 5' G for U6 expression | 50C |
| Tiling 70 nt 12 mismatch distance | gcaacacgtatgtaccaggttcctggaact ggaatctctttccatagaatgttctaaacCa tcctgcggcc (SEQ ID NO: 381) | Has a 5' G for U6 expression | 50C |
| Tiling 70 nt 10 mismatch distance | gcccaacacgtatgtaccaggttcctgga actggaatctctttccatagaatgttctaaac Catcctgcgg (SEQ ID NO: 382) | Has a 5' G for U6 expression | 50C |
| Tiling 70 nt 8 mismatch distance | ggacccaacacgtatgtaccaggttcctg gaactggaatctctttccatagaatgttctaa acCatcctgc (SEQ ID NO: 383) | Has a 5' G for U6 expression | 50C |
| Tiling 70 nt 6 mismatch distance | gttgacccaacacgtatgtaccaggttcct ggaactggaatctctttccatagaatgttct aaacCatcct (SEQ ID NO: 384) | Has a 5' G for U6 expression | 50C |
| Tiling 70 nt 4 mismatch distance | gccttgacccaacacgtatgtaccaggttc ctggaactggaatctctttccatagaatgtt ctaaacCatc (SEQ ID NO: 385) | Has a 5' G for U6 expression | 50C |
| Tiling 70 nt 2 mismatch distance | gttccttgacccaacacgtatgtaccaggtt cctggaactggaatctctttccatagaatgt tctaaacCa (SEQ ID NO: 386) | Has a 5' G for U6 expression | 50C |
| Tiling 84 nt 84 mismatch distance | gCatcctgcggcctctactctgcattcaatt acatactgacacattcggcaacatgttttc ctggtttattttcacacagtcca (SEQ ID NO: 387) | Has a 5' G for U6 expression | 50C |
| Tiling 84 nt 82 mismatch distance | gacCatcctgcggcctctactctgcattca attacatactgacacattcggcaacatgtttt tcctggtttattttcacacagtc (SEQ ID NO: 388) | Has a 5' G for U6 expression | 50C |
| Tiling 84 nt 80 mismatch distance | gaaacCatcctgcggcctctactctgcatt caattacatactgacacattcggcaacatgt ttttcctggtttattttcacacag (SEQ ID NO: 389) | Has a 5' G for U6 expression | 50C |
| Tiling 84 nt 78 mismatch distance | gctaaacCatcctgcggcctctactctgca ttcaattacatactgacacattcggcaacat gttttcctggtttattttcacac (SEQ ID NO: 390) | Has a 5' G for U6 expression | 50C |
| Tiling 84 nt 76 mismatch distance | gttctaaacCatcctgcggcctctactctg cattcaattacatactgacacattcggcaac atgttttcctggtttattttcac (SEQ ID NO: 391) | Has a 5' G for U6 expression | 50C |
| Tiling 84 nt 74 mismatch distance | gtgttctaaacCatcctgcggcctctactct gcattcaattacatactgacacattcggcaa catgttttcctggtttattttc (SEQ ID NO: 392) | Has a 5' G for U6 expression | 50C |

TABLE 14-continued

Guide sequences used in this study for RNA editing in mammalian cells.
Mismatched base flips are capitalized

| Name | Spacer sequence | Notes | First FIG. |
|---|---|---|---|
| Tiling 84 nt 72 mismatch distance | gaatgttctaaacCatcctgcggcctctac tctgcattcaattacatactgacacattcgg caacatgttttcctggtttattt (SEQ ID NO: 393) | Has a 5' G for U6 expression | 50C |
| Tiling 84 nt 70 mismatch distance | gagaatgttctaaacCatcctgcggcctct actctgcattcaattacatactgacacattc ggcaacatgttttcctggtttat (SEQ ID NO: 394) | Has a 5' G for U6 expression | 50C |
| Tiling 84 nt 68 mismatch distance | gatagaatgttctaaacCatcctgcggcct ctactctgcattcaattacatactgacacatt cggcaacatgttttcctggttt (SEQ ID NO: 395) | Has a 5' G for U6 expression | 50C |
| Tiling 84 nt 66 mismatch distance | gccatagaatgttctaaacCatcctgcgg cctctactctgcattcaattacatactgacac attcggcaacatgttttcctggt (SEQ ID NO: 396) | Has a 5' G for U6 expression | 50C |
| Tiling 84 nt 64 mismatch distance | gttccatagaatgttctaaacCatcctgcg gcctctactctgcattcaattacatactgac acattcggcaacatgttttcctg (SEQ ID NO: 397) | Has a 5' G for U6 expression | 50C |
| Tiling 84 nt 62 mismatch distance | gctttccatagaatgttctaaacCatcctgc ggcctctactctgcattcaattacatactga cacattcggcaacatgttttcc (SEQ ID NO: 398) | Has a 5' G for U6 expression | 50C |
| Tiling 84 nt 60 mismatch distance | gctctttccatagaatgttctaaacCatcct gcggcctctactctgcattcaattacatact gacacattcggcaacatgttttt (SEQ ID NO: 399) | Has a 5' G for U6 expression | 50C |
| Tiling 84 nt 58 mismatch distance | gatctctttccatagaatgttctaaacCatc ctgcggcctctactctgcattcaattacata ctgacacattcggcaacatgttt (SEQ ID NO: 400) | Has a 5' G for U6 expression | 50C |
| Tiling 84 nt 56 mismatch distance | ggaatctctttccatagaatgttctaaacCa tcctgcggcctctactctgcattcaattacat actgacacattcggcaacatgt (SEQ ID NO: 401) | Has a 5' G for U6 expression | 50C |
| Tiling 84 nt 54 mismatch distance | gtggaatctctttccatagaatgttctaaac Catcctgcggcctctactctgcattcaatta catactgacacattcggcaacat (SEQ ID NO: 402) | Has a 5' G for U6 expression | 50C |
| Tiling 84 nt 52 mismatch distance | gactggaatctctttccatagaatgttctaaa cCatcctgcggcctctactctgcattcaatt acatactgacacattcggcaac (SEQ ID NO: 403) | Has a 5' G for U6 expression | 50C |
| Tiling 84 nt 50 mismatch distance | ggaactggaatctctttccatagaatgttct aaacCatcctgcggcctctactctgcattc aattacatactgacacattcggca (SEQ ID NO: 404) | Has a 5' G for U6 expression | 50C |
| Tiling 84 nt 48 mismatch distance | gtggaactggaatctctttccatagaatgtt ctaaacCatcctgcggcctctactctgcat tcaattacatactgacacattcgg (SEQ ID NO: 405) | Has a 5' G for U6 expression | 50C |
| Tiling 84 nt 46 mismatch distance | gcctggaactggaatctctttccatagaatg ttctaaacCatcctgcggcctctactctgc attcaattacatactgacacattc (SEQ ID NO: 406) | Has a 5' G for U6 expression | 50C |
| Tiling 84 nt 44 mismatch distance | gttcctggaactggaatctctttccatagaa tgttctaaacCatcctgcggcctctactctg cattcaattacatactgacacat (SEQ ID NO: 407) | Has a 5' G for U6 expression | 50C |

TABLE 14-continued

Guide sequences used in this study for RNA editing in mammalian cells.
Mismatched base flips are capitalized

| Name | Spacer sequence | Notes | First FIG. |
|---|---|---|---|
| Tiling 84 nt 42 mismatch distance | gggttcctggaactggaatctctttccatag aatgttctaaacCatcctgcggcctctact ctgcattcaattacatactgacac (SEQ ID NO: 408) | Has a 5' G for U6 expression | 50C |
| Tiling 84 nt 40 mismatch distance | gcaggttcctggaactggaatctctttccat agaatgttctaaacCatcctgcggcctcta ctctgcattcaattacatactgac (SEQ ID NO: 409) | Has a 5' G for U6 expression | 50C |
| Tiling 84 nt 38 mismatch distance | gaccaggttcctggaactggaatctctttcc atagaatgttctaaacCatcctgcggcctc tactctgcattcaattacatactg (SEQ ID NO: 410) | Has a 5' G for U6 expression | 50C |
| Tiling 84 nt 36 mismatch distance | ggtaccaggttcctggaactggaatctcttt ccatagaatgttctaaacCatcctgcggcc tctactctgcattcaattacatac (SEQ ID NO: 411) | Has a 5' G for U6 expression | 50C |
| Tiling 84 nt 34 mismatch distance | gatgtaccaggttcctggaactggaatctc tttccatagaatgttctaaacCatcctgcgg cctctactctgcattcaattacat (SEQ ID NO: 412) | Has a 5' G for U6 expression | 50C |
| Tiling 84 nt 32 mismatch distance | ggtatgtaccaggttcctggaactggaatc tctttccatagaatgttctaaacCatcctgc ggcctctactctgcattcaattac (SEQ ID NO: 413) | Has a 5' G for U6 expression | 50C |
| Tiling 84 nt 30 mismatch distance | gacgtatgtaccaggttcctggaactggaa tctattccatagaatgttctaaacCatcctg cggcctctactctgcattcaatt (SEQ ID NO: 414) | Has a 5' G for U6 expression | 50C |
| Tiling 84 nt 28 mismatch distance | gacacgtatgtaccaggttcctggaactgg aatctctttccatagaatgttctaaacCatc ctgcggcctctactctgcattcaa (SEQ ID NO: 415) | Has a 5' G for U6 expression | 50C |
| Tiling 84 nt 26 mismatch distance | gcaacacgtatgtaccaggttcctggaact ggaatctctttccatagaatgttctaaacCa tcctgcggcctctactctgcattc (SEQ ID NO: 416) | Has a 5' G for U6 expression | 50C |
| Tiling 84 nt 24 mismatch distance | gcccaacacgtatgtaccaggttcctgga actggaatctctttccatagaatgttctaaac Catcctgcggcctctactctgcat (SEQ ID NO: 417) | Has a 5' G for U6 expression | 50C |
| Tiling 84 nt 22 mismatch distance | ggacccaacacgtatgtaccaggttcctg gaactggaatctctttccatagaatgttctaa acCatcctgcggcctctactctgc (SEQ ID NO: 418) | Has a 5' G for U6 expression | 50C |
| Tiling 84 nt 20 mismatch distance | gttgacccaacacgtatgtaccaggttcct ggaactggaatctctttccatagaatgttct aaacCatcctgcggcctctactct (SEQ ID NO: 419) | Has a 5' G for U6 expression | 50C |
| Tiling 84 nt 18 mismatch distance | gccttgacccaacacgtatgtaccaggttc ctggaactggaatctctttccatagaatgtt ctaaacCatcctgcggcctctact (SEQ ID NO: 420) | Has a 5' G for U6 expression | 50C |
| Tiling 84 nt 16 mismatch distance | gttccttgacccaacacgtatgtaccaggtt cctggaactggaatctctttccatagaatgt tctaaacCatcctgcggcctcta (SEQ ID NO: 421) | Has a 5' G for U6 expression | 50C |
| Tiling 84 nt 14 mismatch distance | gggttccttgacccaacacgtatgtaccag gttcctggaactggaatctctttccatagaa tgttctaaacCatcctgcggcctc (SEQ ID NO: 422) | Has a 5' G for U6 expression | 50C |

TABLE 14-continued

Guide sequences used in this study for RNA editing in mammalian cells.
Mismatched base flips are capitalized

| Name | Spacer sequence | Notes | First FIG. |
|---|---|---|---|
| Tiling 84 nt 12 mismatch distance | gttggttccttgacccaacacgtatgtacca ggttcctggaactggaatctctttccataga atgttctaaacCatcctgcggcc (SEQ ID NO: 423) | Has a 5' G for U6 expression | 50C |
| Tiling 84 nt 10 mismatch distance | gccttggttccttgacccaacacgtatgtac caggttcctggaactggaatctctttccata gaatgttctaaacCatcctgcgg (SEQ ID NO: 424) | Has a 5' G for U6 expression | 50C |
| Tiling 84 nt 8 mismatch distance | ggcccttggttccttgacccaacacgtatgt accaggttcctggaactggaatctattcca tagaatgttctaaacCatcctgc (SEQ ID NO: 425) | Has a 5' G for U6 expression | 50C |
| Tiling 84 nt 6 mismatch distance | gccgcccttggttccttgacccaacacgta tgtaccaggttcctggaactggaatctcttt ccatagaatgttctaaacCatcct (SEQ ID NO: 426) | Has a 5' G for U6 expression | 50C |
| Tiling 84 nt 4 mismatch distance | gcgccgcccttggttccttgacccaacac gtatgtaccaggttcctggaactggaatct ctttccatagaatgttctaaacCatc (SEQ ID NO: 427) | Has a 5' G for U6 expression | 50C |
| Tiling 84 nt 2 mismatch distance | ggtcgccgcccttggttccttgacccaaca cgtatgtaccaggttcctggaactggaatc tctttccatagaatgttctaaacCa (SEQ ID NO: 428) | Has a 5' G for U6 expression | 50C |
| ADAR non-targeting guide | GTAATGCCTGGCTTGTCG ACGCATAGTCTG (SEQ ID NO: 429) | Has a 5' G for U6 expression | 50C |
| PFS binding screen guide for TAG motif | gaaaacgcaggttcctcCagtttcgggag cagcgcacgtctccctgtagtc (SEQ ID NO: 430) | Has a 5' G for U6 expression | 51B |
| PFS binding screen guide for AAC motif | gacgcaggttcctctagCttcgggagcag cgcacgtctccctgtagtcaag (SEQ ID NO: 431) | Has a 5' G for U6 expression | 51B |
| PFS binding screen non-targeting | GTAATGCCTGGCTTGTCG ACGCATAGTCTG (SEQ ID NO: 432) | Has a 5' G for U6 expression | 51B |
| Motif preference targeting guide | gatagaatgttctaaacCatcctgcggcct ctactctgcattcaattacat (SEQ ID NO: 433) | Has a 5' G for U6 expression | 51C |
| Motif preference non-targeting guide | GTAATGCCTGGCTTGTCG ACGCATAGTCTG (SEQ ID NO: 434) | Has a 5' G for U6 expression | 51C |
| PPIB tiling guide 50 mismatch distance | gCaaggccacaaaattatccactgttttg gaacagtctttccgaagagac (SEQ ID NO: 435) | Has a 5' G for U6 expression | 57D |
| PPIB tiling guide 42 mismatch distance | gcctgtagcCaaggccacaaaattatcca ctgttttggaacagtctttcc (SEQ ID NO: 436) | Has a 5' G for U6 expression | 57D |
| PPIB tiling guide 34 mismatch distance | gctttctctcctgtagcCaaggccacaaaa ttatccactgttttggaaca (SEQ ID NO: 437) | Has a 5' G for U6 expression | 57D |
| PPIB tiling guide 26 mismatch distance | ggccaaatcctttctctcctgtagcCaagg ccacaaaattatccactgttt (SEQ ID NO: 438) | Has a 5' G for U6 expression | 57D |
| PPIB tiling guide 18 mismatch distance | gttttgtagccaaatcctttctctcctgtagc Caaggccacaaaattatc (SEQ ID NO: 439) | Has a 5' G for U6 expression | 57D |

TABLE 14-continued

Guide sequences used in this study for RNA editing in mammalian cells.
Mismatched base flips are capitalized

| Name | Spacer sequence | Notes | First FIG. |
|---|---|---|---|
| PPIB tiling guide 10 mismatch distance | gatttgctgtttttgtagccaaatcctttctct cctgtagcCaaggccaca (SEQ ID NO: 440) | Has a 5' G for U6 expression | 57D |
| PPIB tiling guide 2 mismatch distance | gacgatggaatttgctgtttttgtagccaaat cctttctctcctgtagcCa (SEQ ID NO: 441) | Has a 5' G for U6 expression | 57D |
| Targeting guide, opposite base G | gatagaatgttctaaacGatcctgcggcct ctactctgcattcaattacat (SEQ ID NO: 442) | Has a 5' G for U6 expression | 57D |
| Targeting guide, opposite base A | gatagaatgttctaaacAatcctgcggcct ctactctgcattcaattacat (SEQ ID NO: 443) | Has a 5' G for U6 expression | 57D |
| Targeting guide, opposite base C | gatagaatgttctaaacTatcctgcggcct ctactctgcattcaattacat (SEQ ID NO: 444) | Has a 5' G for U6 expression | 57D |
| AVPR2 guide 37 mismatch distance | ggtcccacgcggccCacagctgcacca ggaagaagggtgcccagcacagca (SEQ ID NO: 445) | Has a 5' G for U6 expression | 52A |
| AVPR2 guide 35 mismatch distance | ggggtcccacgcggccCacagctgcac caggaagaagggtgcccagcacag (SEQ ID NO: 446) | Has a 5' G for U6 expression | 52A |
| AVPR2 guide 33 mismatch distance | gccgggtcccacgcggccCacagctgc accaggaagaagggtgcccagcac (SEQ ID NO: 447) | Has a 5' G for U6 expression | 52A |
| FANCC guide 37 mismatch distance | gggtgatgacatccCaggcgatcgtgtg gcctccaggagcccagagcagga (SEQ ID NO: 448) | Has a 5' G for U6 expression | 52B |
| FANCC guide 35 mismatch distance | gagggtgatgacatccCaggcgatcgtg tggcctccaggagcccagagcag (SEQ ID NO: 449) | Has a 5' G for U6 expression | 52B |
| FANCC guide 32 mismatch distance | gatcagggtgatgacatccCaggcgatc gtgtggcctccaggagcccagag (SEQ ID NO: 450) | Has a 5' G for U6 expression | 52B |
| Synthetic disease gene target IL2RG | ggtggctccattcactcCaatgctgagca cttccacagagtgggttaaagc (SEQ ID NO: 451) | Has a 5' G for U6 expression | 52E |
| Synthetic disease gene target F8 | gttttctaatatattttgCcagactgatggact attctcaattaataatgat (SEQ ID NO: 452) | Has a 5' G for U6 expression | 52E |
| Synthetic disease gene target LDLR | gagatgttgctgtggatCcagtccacagc cagcccgtcggggggcctggatg (SEQ ID NO: 453) | Has a 5' G for U6 expression | 52E |
| Synthetic disease gene target CBS | gcaggccggcccagctgCcaggtgcac ctgctcggagcatcgggccggatc (SEQ ID NO: 454) | Has a 5' G for U6 expression | 52E |
| Synthetic disease gene target HBB | gcaaagaacctctgggtCcaagggtaga ccaccagcagcctgcccagggcc (SEQ ID NO: 455) | Has a 5' G for U6 expression | 52E |
| Synthetic disease gene target ALDOB | gaagagaaacttagtttCcagggattggt agagggcaaaggttgatagca (SEQ ID NO: 456) | Has a 5' G for U6 expression | 52E |
| Synthetic disease gene target DMD | gtcagccagtgcagagCcactggtagtt ggtggttagagtttcaagttcc (SEQ ID NO: 457) | Has a 5' G for U6 expression | 52E |

TABLE 14-continued

Guide sequences used in this study for RNA editing in mammalian cells. Mismatched base flips are capitalized

| Name | Spacer sequence | Notes | First FIG. |
|---|---|---|---|
| Synthetic disease gene target SMAD4 | ggctcattgtgaacaggCcagtaatgtcc gggatggggcggcataggcggg (SEQ ID NO: 458) | Has a 5' G for U6 expression | 52E |
| Synthetic disease gene target BRCA2 | gtagctaaagaacttgaCcaagacatatc aggatccacctcagctcctaga (SEQ ID NO: 459) | Has a 5' G for U6 expression | 52E |
| Synthetic disease gene target GRIN2A | ggggcattgttctgtgcCcagtcctgctgg tagacctgctccccggtggct (SEQ ID NO: 460) | Has a 5' G for U6 expression | 52E |
| Synthetic disease gene target SCN9A | gagaagtcgttcatgtgCcaccgtggga gcgtacagtcatcattgatcttg (SEQ ID NO: 461) | Has a 5' G for U6 expression | 52E |
| Synthetic disease gene target TARDBP | gggattaatgctgaacgCaccaaagttca tcccaccacccatattactacc (SEQ ID NO: 462) | Has a 5' G for U6 expression | 52E |
| Synthetic disease gene target CFTR | gctccaaaggctttcctCcactgttgcaaa gttattgaatcccaagacaca (SEQ ID NO: 463) | Has a 5' G for U6 expression | 52E |
| Synthetic disease gene target UBE3A | gatgaatgaacgatttcCcagaactcccta atcagaacagagtccctggta (SEQ ID NO: 464) | Has a 5' G for U6 expression | 52E |
| Synthetic disease gene target SMPD1 | ggagcctctgccggagcCcagagaacc cgagagtcagacagagccagcgcc (SEQ ID NO: 465) | Has a 5' G for U6 expression | 52E |
| Synthetic disease gene target USH2A | ggcttccgtggagacacCcaatcaatttg aagagatcttgaagtgatgcca (SEQ ID NO: 466) | Has a 5' G for U6 expression | 52E |
| Synthetic disease gene target MEN1 | gtgggactgccctcctcCcatttgcagatg ccgtcgtagaatcgcagcagg (SEQ ID NO: 467) | Has a 5' G for U6 expression | 52E |
| Synthetic disease gene target C8orf37 | gatatcaatagttctCcagctacactggc aggcatatgcccgtgttcct (SEQ ID NO: 468) | Has a 5' G for U6 expression | 52E |
| Synthetic disease gene target MLH1 | gattccttttcttcgtcCcaattcacctcagt ggctagtcgaagaatgaag (SEQ ID NO: 469) | Has a 5' G for U6 expression | 52E |
| Synthetic disease gene target TSC2 | gcagcttcagcaccttcCagtcagactcct gcttcaagcactgcagcagga (SEQ ID NO: 470) | Has a 5' G for U6 expression | 52E |
| Synthetic disease gene target NF1 | gccatttgcttgcagtgCcactccagagg attccggattgccataaatact (SEQ ID NO: 471) | Has a 5' G for U6 expression | 52E |
| Synthetic disease gene target MSH6 | gttcaatagttttggtcCagtatcgtttacag cccttcttggtagatttca (SEQ ID NO: 472) | Has a 5' G for U6 expression | 52E |
| Synthetic disease gene target SMN1 | ggcaaccgtcttctgacCaaatggcagaa catttgtccccaactttccact (SEQ ID NO: 473) | Has a 5' G for U6 expression | 52E |
| Synthetic disease gene target SH3TC2 | gcgactttccaatgaacCactgaagccca ggtatgacaaagccgatgatct (SEQ ID NO: 474) | Has a 5' G for U6 expression | 52E |
| Synthetic disease gene target DNAH5 | gtttacactcatgcttcCacagctttaacag atcatttggttccttgatga (SEQ ID NO: 475) | Has a 5' G for U6 expression | 52E |

TABLE 14-continued

Guide sequences used in this study for RNA editing in mammalian cells. Mismatched base flips are capitalized

| Name | Spacer sequence | Notes | First FIG. |
|---|---|---|---|
| Synthetic disease gene target MECP2 | gcttaagcttccgtgtcCagccttcaggca gggtggggtcatcatacatgg (SEQ ID NO: 476) | Has a 5' G for U6 expression | 52E |
| Synthetic disease gene target ADGRV1 | ggacagctgggctgatcCatgatgtcatc cagaaacactggggaccctcag (SEQ ID NO: 477) | Has a 5' G for U6 expression | 52E |
| Synthetic disease gene target AHI1 | gtctcatctcaactttcCatatccgtatcatg gaatcatagcatcctgtaa (SEQ ID NO: 478) | Has a 5' G for U6 expression | 52E |
| Synthetic disease gene target PRKN | gcatgcagacgcggttcCactcgcagcc acagttccagcaccactcgagcc (SEQ ID NO: 479) | Has a 5' G for U6 expression | 52E |
| Synthetic disease gene target COL3A1 | gttggttagggtcaaccCagtattctccac tcttgagttcaggatggcaga (SEQ ID NO: 480) | Has a 5' G for U6 expression | 52E |
| Synthetic disease gene target BRCA1 | gctacactgtccaacacCcactctcgggt caccacaggtgcctcacacatc (SEQ ID NO: 481) | Has a 5' G for U6 expression | 52E |
| Synthetic disease gene target MYBPC3 | gctgcactgtgtaccccCagagctccgtg ttgccgacatcctggggtggct (SEQ ID NO: 482) | Has a 5' G for U6 expression | 52E |
| Synthetic disease gene target APC | gagatcctgccactccCaacaggtttcac agtaagcgcgtatctgttcca (SEQ ID NO: 483) | Has a 5' G for U6 expression | 52E |
| Synthetic disease gene target BMPR2 | gacggcaagagcttaccCagtcacttgtg tggagacttaaatacttgcata (SEQ ID NO: 484) | Has a 5' G for U6 expression | 52E |
| KRAS tiling guide 50 mismatch distance | gCaaggccacaaaattatccactgttttg gaacagtctttccgaagagac (SEQ ID NO: 485) | Has a 5' G for U6 expression | 53A |
| KRAS tiling guide 42 mismatch distance | gcctgtagcCaaggccacaaaattatcca ctgttttggaacagtctttcc (SEQ ID NO: 486) | Has a 5' G for U6 expression | 53A |
| KRAS tiling guide 34 mismatch distance | gctttctctcctgtagcCaaggccacaaaa ttatccactgttttggaaca (SEQ ID NO: 487) | Has a 5' G for U6 expression | 53A |
| KRAS tiling guide 26 mismatch distance | ggccaaatcctttctctcctgtagcCaagg ccacaaaattatccactgttt (SEQ ID NO: 488) | Has a 5' G for U6 expression | 53A |
| KRAS tiling guide 18 mismatch distance | gtttttgtagccaaatcctttctctcctgtagc CaaggccacaaaattatC (SEQ ID NO: 489) | Has a 5' G for U6 expression | 53A |
| KRAS tiling guide 10 mismatch distance | gatttgctgttttgtagccaaatcctttctct cctgtagcCaaggccaca (SEQ ID NO: 490) | Has a 5' G for U6 expression | 53A |
| KRAS tiling guide 2 mismatch distance | gacgatggaatttgctgtttttgtagccaaat cctttctctcctgtagcCa (SEQ ID NO: 491) | Has a 5' G for U6 expression | 53A |
| KRAS tiling non-targeting guide | GTAATGCCTGGCTTGTCG ACGCATAGTCTG (SEQ ID NO: 492) | Has a 5' G for U6 expression | 53A |

TABLE 14-continued

Guide sequences used in this study for RNA editing in mammalian cells.
Mismatched base flips are capitalized

| Name | Spacer sequence | Notes | First FIG. |
|---|---|---|---|
| Luciferase W85X targeting guide for transcriptome specificity | gatagaatgttctaaacCatcctgcggcct ctactctgcattcaattacat (SEQ ID NO: 493) | Has a 5' G for U6 expression | 53B |
| Non-targeting guide for transcriptome specificity | GCAGGGTTTTCCCAGTCA CGACGTTGTAAAGTTG (SEQ ID NO: 494) | Has a 5' G for U6 expression | 53C |
| endogenous KRAS guide 2 | gtcaaggcactcttgccCacgccaccag ctccaactaccacaagtttatat (SEQ ID NO: 495) | Has a 5' G for U6 expression | 54F |
| endogenous PPIB guide 1 | gcaaagatcacccggccCacatcttcatc tccaattcgtaggtcaaaatac (SEQ ID NO: 496) | Has a 5' G for U6 expression | 54G |
| endogenous KRAS guide 1 | GcgccaccagctccaacCaccacaagtt tatattcagtcattttcagcagg (SEQ ID NO: 497) | Has a 5' G for U6 expression | 54F |
| endogenous KRAS guide 3 | GtttctccatcaattacCacttgatcctgta ggaatcctctattGTtgga (SEQ ID NO: 498) | Has a 5' G for U6 expression | 54F |
| endogenous PPM guide 2 | GctttctctcctgtagcCaaggccacaaa attatccactgttttggaaca (SEQ ID NO: 499) | Has a 5' G for U6 expression | 54G |
| endogenous non-targeting guide | GTAATGCCTGGCTTGTCG ACGCATAGTCTG (SEQ ID NO: 500) | Has a 5' G for U6 expression | 54F |
| BoxB Cluc guide | tctttccataGGCCCTGAAAAA GGGCCtgttctaaacCatcctgcggc ctctactcGGCCCTGAAAAAG GGCCattcaattac (SEQ ID NO: 501) | Has a 5' G for U6 expression | 62B |
| BoxB non-targeting guide | cagctggcgaGGCCCTGAAAA AGGGCCggggatgtgcCgcaaggc gattaagttggGGCCCTGAAAA AGGGCCacgccagggt (SEQ ID NO: 502) | Has a 5' G for U6 expression | 62B |
| Stafforst full length ADAR2 guide 1 | GTGGAATAGTATAACAAT ATGCTAAATGTTGTTATA GTATCCCACtctaaaCCAtcctg cgGGGCCCTCTTCAGGGCCC (SEQ ID NO: 503) | Has a 5' G for U6 expression | 62C |
| Stafforst full length ADAR2 non-targeting guide | GTGGAATAGTATAACAAT ATGCTAAATGTTGTTATA GTATCCCACaccctggcgttaccc aGGGCCCTCTTCAGGGCCC (SEQ ID NO: 504) | Has a 5' G for U6 expression | 62C |

REFERENCES

1. P. D. Hsu, E. S. Lander, F. Zhang, Development and applications of CRISPR-Cas9 for genome engineering. Cell 157, 1262-1278 (2014).
2. A. C. Komor, A. H. Badran, D. R. Liu, CRISPR-Based Technologies for the Manipulation of Eukaryotic Genomes. Cell 168, 20-36 (2017).
3. L. Cong et al., Multiplex genome engineering using CRISPR/Cas systems. Science 339, 819-823 (2013).
4. P. Mali et al., RNA-guided human genome engineering via Cas9. Science 339, 823-826 (2013).
5. B. Zetsche et al., Cpf1 is a single RNA-guided endonuclease of a class 2 CRISPR-Cas system. Cell 163, 759-771 (2015).
6. H. Kim, J. S. Kim, A guide to genome engineering with programmable nucleases. Nat Rev Genet 15, 321-334 (2014).
7. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
8. K. Nishida et al., Targeted nucleotide editing using hybrid prokaryotic and vertebrate adaptive immune systems. Science 353, (2016).
9. Y. B. Kim et al., Increasing the genome-targeting scope and precision of base editing with engineered Cas9-cytidine deaminase fusions. Nat Biotechnol 35, 371-376 (2017).
10. O. O. Abudayyeh et al., C2c2 is a single-component programmable RNA-guided RNA-targeting CRISPR effector. Science 353, aaf5573 (2016).
11. S. Shmakov et al., Discovery and Functional Characterization of Diverse Class 2 CRISPR-Cas Systems. Mol Cell 60, 385-397 (2015).
12. S. Shmakov et al., Diversity and evolution of class 2 CRISPR-Cas systems. Nat Rev Microbiol 15, 169-182 (2017).
13. A. A. Smargon et al., Cas13b Is a Type VI-B CRISPR-Associated RNA-Guided RNase Differentially Regulated by Accessory Proteins Csx27 and Csx28. Mol Cell 65, 618-630 e617 (2017).
14. J. S. Gootenberg et al., Nucleic acid detection with CRISPR-Cas13a/C2c2. Science 356, 438-442 (2017).
15. O. O. Abudayyeh et al., RNA targeting with CRISPR-Cas13a. Nature in press, (2017).
16. K. Nishikura, Functions and regulation of RNA editing by ADAR deaminases. Annu Rev Biochem 79, 321-349 (2010).
17. B. L. Bass, H. Weintraub, An unwinding activity that covalently modifies its double-stranded RNA substrate. Cell 55, 1089-1098 (1988).
18. M. M. Matthews et al., Structures of human ADAR2 bound to dsRNA reveal base-flipping mechanism and basis for site selectivity. Nat Struct Mol Biol 23, 426-433 (2016).
19. A. Kuttan, B. L. Bass, Mechanistic insights into editing-site specificity of ADARs. Proc Natl Acad Sci USA 109, E3295-3304 (2012).
20. S. K. Wong, S. Sato, D. W. Lazinski, Substrate recognition by ADAR1 and ADAR2. RNA 7, 846-858 (2001).
21. M. Fukuda et al., Construction of a guide-RNA for site-directed RNA mutagenesis utilising intracellular A-to-I RNA editing. Sci Rep 7, 41478 (2017).
22. M. F. Montiel-Gonzalez, I. Vallecillo-Viejo, G. A. Yudowski, J. J. Rosenthal, Correction of mutations within the cystic fibrosis transmembrane conductance regulator by site-directed RNA editing. Proc Natl Acad Sci USA 110, 18285-18290 (2013).
23. M. F. Montiel-Gonzalez, I. C. Vallecillo-Viejo, J. J. Rosenthal, An efficient system for selectively altering genetic information within mRNAs. Nucleic Acids Res 44, e157 (2016).
24. J. Wettengel, P. Reautschnig, S. Geisler, P. J. Kahle, T. Stafforst, Harnessing human ADAR2 for RNA repair—Recoding a PINK1 mutation rescues mitophagy. Nucleic Acids Res 45, 2797-2808 (2017).
25. Y. Wang, J. Havel, P. A. Beal, A Phenotypic Screen for Functional Mutants of Human Adenosine Deaminase Acting on RNA 1. ACS Chem Biol 10, 2512-2519 (2015).
26. K. A. Lehmann, B. L. Bass, Double-stranded RNA adenosine deaminases ADAR1 and ADAR2 have overlapping specificities. Biochemistry 39, 12875-12884 (2000).
27. Y. Zheng, C. Lorenzo, P. A. Beal, DNA editing in DNA/RNA hybrids by adenosine deaminases that act on RNA. Nucleic Acids Res 45, 3369-3377 (2017).
28. K. Gao et al., A de novo loss-of-function GRIN2A mutation associated with childhood focal epilepsy and acquired epileptic aphasia. PLoS One 12, e0170818 (2017).
29. H. M. Lanoiselee et al., APP, PSEN1, and PSEN2 mutations in early-onset Alzheimer disease: A genetic screening study of familial and sporadic cases. PLoS Med 14, e1002270 (2017).
30. C. Ballatore, V. M. Lee, J. Q. Trojanowski, Tau-mediated neurodegeneration in Alzheimer's disease and related disorders. Nat Rev Neurosci 8, 663-672 (2007).
31. Y. Li et al., Carriers of rare missense variants in IFIH1 are protected from psoriasis. J Invest Dermatol 130, 2768-2772 (2010).
32. R. S. Finkel et al., Treatment of infantile-onset spinal muscular atrophy with nusinersen: a phase 2, open-label, dose-escalation study. Lancet 388, 3017-3026 (2016).

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (546 sequences)

SEQ ID NO: 1 - protein, 7 aa, Simian virus 40
PKKKRKV

SEQ ID NO: 2 - protein, 16 aa, Artificial Sequence
  Synthetic
KRPAATKKAGQAKKKK

SEQ ID NO: 3 - protein, 9 aa, Artificial Sequence
  Synthetic
PAAKRVKLD

SEQ ID NO: 4 - protein, 11 aa, Artificial Sequence
  Synthetic
RQRRNELKRSP

SEQ ID NO: 5 - protein, 38 aa, Artificial Sequence
  Synthetic
NQSSNFGPMKGGNFGGRSSGPYGGGGQYFAKPRNQGGY

SEQ ID NO: 6 - protein, 42 aa, Artificial Sequence
  Synthetic
RMRIZFKNKGKDTAELRRRRVEVSVELRKAKKDEQILKRRNV

SEQ ID NO: 7 - protein, 8 aa, Artificial Sequence
  Synthetic
VSRKRPRP

SEQ ID NO: 8 - protein, 8 aa, Artificial Sequence
  Synthetic
PPKKARED

SEQ ID NO: 9 - protein, 8 aa, Homo sapiens
  MISC_FEATURE (2)..(2): Xaa at position 2 represents glutamine
PXPKKKPL

SEQ ID NO: 10 - protein, 12 aa, Mus sp.
SALIKKKKKMAP

SEQ ID NO: 11 - protein, 5 aa, Influenza virus
DRLRR

SEQ ID NO: 12 - protein, 7 aa, Influenza virus
PKQKKRK

SEQ ID NO: 13 - protein, 10 aa, Hepatitis D virus
RKLKKKIKKL

SEQ ID NO: 14 - protein, 10 aa, Mus sp.
REKKKFLKRR

SEQ ID NO: 15 - protein, 20 aa, Homo sapiens
KRKGDEVDGVDEVAKKKSKK

SEQ ID NO: 16 - protein, 17 aa, Homo sapiens
RKCLQAGMNLEARKTKK

SEQ ID NO: 17 - protein, 12 aa, Artificial Sequence
  Synthetic
FWYHKMILVAGC

SEQ ID NO: 18 - protein, 12 aa, Artificial Sequence
  Synthetic
WYHKREDCSTNQ

SEQ ID NO: 19 - protein, 9 aa, Artificial Sequence
  Synthetic
VCAGSPTND

SEQ ID NO: 20 - protein, 4 aa, Artificial Sequence
  Synthetic
FWYH

SEQ ID NO: 21 - protein, 5 aa, Artificial Sequence
  Synthetic
HKRED

SEQ ID NO: 22 - protein, 15 aa, Artificial Sequence
  Synthetic
  misc_feature (4)..(4): Xaa can be any naturally occurring amino acid
DKHXFGAFLNLARHN

SEQ ID NO: 23 - protein, 12 aa, Artificial Sequence
  Synthetic
GLLFFVSLFLDK

SEQ ID NO: 24 - protein, 7 aa, Artificial Sequence
  Synthetic
  misc_feature (4)..(4): Xaa can be any naturally occurring amino acid
SKIXGFK

SEQ ID NO: 25 - protein, 10 aa, Artificial Sequence
  Synthetic
  misc_feature (7)..(7): Xaa can be any naturally occurring amino acid
DMLNELXRCP

SEQ ID NO: 26 - protein, 15 aa, Artificial Sequence
  Synthetic
  misc_feature (2)..(2): Xaa can be any naturally occurring amino acid
  misc_feature (14)..(14): Xaa can be any naturally occurring amino acid
RXZDRFPYFALRYXD

SEQ ID NO: 27 - protein, 10 aa, Artificial Sequence
  Synthetic
  misc_feature (9)..(9): Xaa can be any naturally occurring amino acid
LRFQVBLGXY

SEQ ID NO: 28 - protein, 10 aa, Artificial Sequence
  Synthetic
GLLFFVSLFL

SEQ ID NO: 29 - protein, 9 aa, Artificial Sequence
  Synthetic
  misc_feature (4)..(4): Xaa can be any naturally occurring amino acid
RHQXRFPYF

SEQ ID NO: 30 - protein, 8 aa, Artificial Sequence
  Synthetic
RHQDRFPY

SEQ ID NO: 31 - protein, 1149 aa, Sinomicrobial oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 32 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 33 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 34 - protein, 1161 aa, Bacteroidetes bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 35 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 36 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 37 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 38 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 39 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 40 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 41 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 42 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 43 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 44 - protein, 953 aa, Alistipes sp. ZOR0009
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 45 - protein, 1322 aa, Prevotella sp. MA2016
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 46 - protein, 1322 aa, Prevotella sp. MA2016; identical to SEQ ID NO: 45

SEQ ID NO: 47 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 48 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 49 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 50 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 51 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 52 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 53 - protein, 1090 aa, Prevotella sp. P5-125
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 54 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 55 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 56 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 57 - protein, 1175 aa, Porphyromonas sp.
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 58 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 59 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 60 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 61 - protein, 1127 aa, Prevotella buccae; identical to SEQ ID NO: 41

SEQ ID NO: 62 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 63 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 64 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 65 - protein, 1224 aa, Bergeyella zoohelcum; identical to SEQ ID NO: 39

SEQ ID NO: 66 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 67 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 68 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 69 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 70 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 71 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 72 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 73 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 74 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 75 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 76 - protein, 1125 aa, Prevotella pallens; identical to SEQ ID NO: 62

SEQ ID NO: 77 - protein, 1157 aa, Myroides odoratimimus; identical to SEQ ID NO: 63

SEQ ID NO: 78 - protein, 1157 aa, Myroides odoratimimus; identical to SEQ ID NO: 64

SEQ ID NO: 79 - protein, 1127 aa, Prevotella sp.
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 80 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 81 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 82 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 83 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 84 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 85 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 86 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 87 - protein, 1135 aa, Porphyromonas gingivalis; identical to SEQ ID NO: 69

SEQ ID NO: 88 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 89 - protein, 1135 aa, Porphyromonas gingivalis; identical to SEQ ID NO: 70

SEQ ID NO: 90 - protein, 1135 aa, Porphyromonas gingivalis; identical to SEQ ID NO: 71

SEQ ID NO: 91 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 92 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 93 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 94 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 95 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 96 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 97 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 98 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 99 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 100 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 101 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 102 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 103 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 104 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 105 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 106 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 107 - protein, 1155 aa, Flavobacterium sp.
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 108 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 109 - protein, 1146 aa, Chryseobacterium sp.
CMETQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 110 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 111 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 112 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 113 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 114 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 115 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 116 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 117 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 118 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 119 - protein, 1340 aa, Lachnospiraceae bacterium
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 120 - protein, 1437 aa, Lachnospiraceae bacterium
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 121 - protein, 1385 aa, Clostridium] aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 122 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 123 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 124 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 125 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 126 - protein, 1051 aa, Listeria newyorkensis
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 127 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 128 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 129 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 130 - protein, 1285 aa, Rhodobacter capsulatus; identical to SEQ ID NO: 129

SEQ ID NO: 131 - protein, 1389 aa, Unknown
  Synthetic
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 132 - protein, 1197 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 133 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 134 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 135 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 136 - protein, 1344 aa, Eubacterium] rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 137 - protein, 1373 aa, Eubacteriaceae bacterium
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 138 - protein, 1276 aa, Blautia sp.
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 139 - protein, 1385 aa, Leptotrichia sp.
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 140 - protein, 1334 aa, Lachnospiraceae bacterium
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 141 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 142 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 143 - protein, 1235 aa, Thalassospira sp.
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 144 - protein, 1312 aa, Pseudobutyrivibrio sp.
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 145 - protein, 1343 aa, Butyrivibrio sp.
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 146 - protein, 1276 aa, Blautia sp.; identical to SEQ ID NO: 138

SEQ ID NO: 147 - protein, 1168 aa, Leptotrichia sp.
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 148 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 149 - protein, 697 aa, Porphyromonadaceae bacterium
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 150 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 151 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 152 - protein, 15 aa, Artificial Sequence
  Synthetic
GGGGSGGGGSGGGGS

SEQ ID NO: 153 - protein, 18 aa, Artificial Sequence
  Synthetic
GGSGGSGGSGGSGGSGGS

SEQ ID NO: 154 - protein, 16 aa, Artificial Sequence
  Synthetic
SGSETPGTSESATPES

SEQ ID NO: 155 - RNA, 28 nt, Artificial Sequence
  Synthetic
gccagcuuuccgggcauuggcuuccauc

SEQ ID NO: 156 - DNA, 28 bp, Artificial Sequence
  Synthetic
gccagctttccgggcattggcttccatc

SEQ ID NO: 157 - DNA, 28 bp, Artificial Sequence
  Synthetic
acccaggaatctcaggaatgtcgacgat

SEQ ID NO: 158 - DNA, 28 bp, Artificial Sequence
  Synthetic
agggttttcccagtcacgacgttgtaaa

SEQ ID NO: 159 - DNA, 30 bp, Artificial Sequence
  Synthetic
gggcattggcttccatctctttgagcacct

SEQ ID NO: 160 - RNA, 30 nt, Artificial Sequence
  Synthetic
gugcagccagcuuuccgggcauuggcuucc

SEQ ID NO: 161 - RNA, 30 nt, Artificial Sequence
  Synthetic
gcagccagcuuuccgggcauuggcuuccau

SEQ ID NO: 162 - RNA, 30 nt, Artificial Sequence
  Synthetic
ggcuuccaucucuuugagcaccuccagcgg

SEQ ID NO: 163 - RNA, 30 nt, Artificial Sequence
  Synthetic
ggaaugucgacgaucgccucgccuaugccg

SEQ ID NO: 164 - RNA, 30 nt, Artificial Sequence
  Synthetic
gaaugucgacgaucgccucgccuaugccgc

SEQ ID NO: 165 - RNA, 30 nt, Artificial Sequence
  Synthetic
gaccugugcgaugaacugcuccaugggcuc

SEQ ID NO: 166 - RNA, 30 nt, Artificial Sequence
  Synthetic
guguggcagcguccugggaugaacuucuuc

SEQ ID NO: 167 - RNA, 30 nt, Artificial Sequence
  Synthetic
guggcagcguccugggaugaacuucuucau

SEQ ID NO: 168 - RNA, 30 nt, Artificial Sequence
  Synthetic
gcuucuugccgggcaacuucccgcggucag

SEQ ID NO: 169 - RNA, 31 nt, Artificial Sequence
  Synthetic
gcaggguuuucccagucacgacguuguaaaa

SEQ ID NO: 170 - RNA, 31 nt, Artificial Sequence; identical to SEQ ID NO: 169
  Synthetic

SEQ ID NO: 171 - RNA, 28 nt, Artificial Sequence
  Synthetic
acccaggaaucucaggaaugucgacgau

SEQ ID NO: 172 - DNA, 21 bp, Artificial Sequence
  Synthetic
cagctttccgggcattggctt

SEQ ID NO: 173 - RNA, 30 nt, Artificial Sequence
  Synthetic
ccgcuggaggugcucaaagagauggaagcc

SEQ ID NO: 174 - DNA, 28 bp, Artificial Sequence
  Synthetic
gccagctttccgggcattggcttccatc

SEQ ID NO: 175 - DNA, 28 bp, Artificial Sequence
  Synthetic
acccaggaatctcaggaatgtcgacgat

SEQ ID NO: 176 - DNA, 30 bp, Artificial Sequence; identical to SEQ ID NO: 159
  Synthetic

SEQ ID NO: 177 - RNA, 30 nt, Artificial Sequence; identical to SEQ ID NO: 164
  Synthetic

SEQ ID NO: 178 - DNA, 28 bp, Artificial Sequence
  Synthetic
caaggcactcttgcctacgccaccagct

SEQ ID NO: 179 - DNA, 28 bp, Artificial Sequence
  Synthetic
tcatattcgtccacaaaatgattctgaa

SEQ ID NO: 180 - DNA, 28 bp, Artificial Sequence
  Synthetic
attatttatggcaaatacacaaagaaag

SEQ ID NO: 181 - DNA, 28 bp, Artificial Sequence
  Synthetic
gaatatcttcaaatgatttagtattatt

SEQ ID NO: 182 - DNA, 28 bp, Artificial Sequence
  Synthetic
accataggtacatcttcagagtccttaa

SEQ ID NO: 183 - DNA, 30 bp, Artificial Sequence
  Synthetic
gtcaaggcactcttgcctacgccaccagct

SEQ ID NO: 184 - DNA, 30 bp, Artificial Sequence
  Synthetic
gatcatattcgtccacaaaatgattctgaa

SEQ ID NO: 185 - DNA, 30 bp, Artificial Sequence
  Synthetic
gtattatttatggcaaatacacaaagaaag

SEQ ID NO: 186 - DNA, 30 bp, Artificial Sequence
  Synthetic
gtgaatatcttcaaatgatttagtattatt

SEQ ID NO: 187 - DNA, 30 bp, Artificial Sequence
  Synthetic
ggaccataggtacatcttcagagtccttaa

SEQ ID NO: 188 - DNA, 50 bp, Artificial Sequence
  Synthetic
aagagtgccttgacgatacagcctcgaggctgtatcgtcaaggcactctt

SEQ ID NO: 189 - DNA, 48 bp, Artificial Sequence
  Synthetic
aatcattttgtggacgaatatctcgagatattcgtccacaaaatgatt

SEQ ID NO: 190 - DNA, 48 bp, Artificial Sequence
  Synthetic
aaataatactaaatcatttgactcgagtcaaatgatttagtattattt

SEQ ID NO: 191 - DNA, 48 bp, Artificial Sequence
  Synthetic
aataatactaaatcatttgaactcgagttcaaatgatttagtattatt

SEQ ID NO: 192 - DNA, 48 bp, Artificial Sequence
  Synthetic
aaggactctgaagatgtacctctcgagaggtacatcttcagagtcctt

SEQ ID NO: 193 - DNA, 30 bp, Artificial Sequence
  Synthetic
gagatcagggcaaacagaactttgactccc

SEQ ID NO: 194 - DNA, 30 bp, Artificial Sequence
  Synthetic
ggatgcagatcagggcaaacagaactttga

SEQ ID NO: 195 - DNA, 30 bp, Artificial Sequence
  Synthetic
gcacagcgatgcagatcagggcaaacagaa

SEQ ID NO: 196 - DNA, 30 bp, Artificial Sequence
  Synthetic
gctcggccacagcgatgcagatcagggcaa

SEQ ID NO: 197 - DNA, 30 bp, Artificial Sequence
  Synthetic
ggggcttggcctcggccacagcgatgcaga

SEQ ID NO: 198 - DNA, 30 bp, Artificial Sequence
  Synthetic
gtgggcttggcctcggccacagcgatgcag

SEQ ID NO: 199 - DNA, 30 bp, Artificial Sequence
  Synthetic
gtctcggtgggcttggcctcggccacagcg

SEQ ID NO: 200 - DNA, 30 bp, Artificial Sequence
  Synthetic
gttcgttgttctcggtgggcttggcctcgg

SEQ ID NO: 201 - DNA, 30 bp, Artificial Sequence
  Synthetic
ggaagtcttcgttgttctcggtgggcttgg

SEQ ID NO: 202 - DNA, 30 bp, Artificial Sequence
  Synthetic
gatgttgaagtcttcgttgttctcggtggg

SEQ ID NO: 203 - DNA, 30 bp, Artificial Sequence
  Synthetic
gcggccacgatgttgaagtcttcgttgttc

SEQ ID NO: 204 - DNA, 30 bp, Artificial Sequence
  Synthetic
gtggccacggccacgatgttgaagtcttcg

SEQ ID NO: 205 - DNA, 30 bp, Artificial Sequence
  Synthetic
ggttgctggccacggccacgatgttgaagt

SEQ ID NO: 206 - DNA, 30 bp, Artificial Sequence
  Synthetic
gtcgcgaagttgctggccacggccacgatg

SEQ ID NO: 207 - DNA, 30 bp, Artificial Sequence
  Synthetic
gccgtggtcgcgaagttgctggccacggcc

SEQ ID NO: 208 - DNA, 30 bp, Artificial Sequence
  Synthetic
gcgagatccgtggtcgcgaagttgctggcc

SEQ ID NO: 209 - DNA, 30 bp, Artificial Sequence
  Synthetic
gcagcatcgagatccgtggtcgcgaagttg

SEQ ID NO: 210 - DNA, 30 bp, Artificial Sequence
  Synthetic
gggtcagcatcgagatccgtggtcgcgaag

SEQ ID NO: 211 - DNA, 30 bp, Artificial Sequence
  Synthetic
gcttcccgcggtcagcatcgagatccgtgg

SEQ ID NO: 212 - DNA, 30 bp, Artificial Sequence
  Synthetic
ggggcaacttcccgcggtcagcatcgagat

SEQ ID NO: 213 - DNA, 30 bp, Artificial Sequence
  Synthetic
gtcttgccgggcaacttcccgcggtcagca

SEQ ID NO: 214 - DNA, 30 bp, Artificial Sequence
  Synthetic
ggcagcttcttgccgggcaacttcccgcgg

SEQ ID NO: 215 - DNA, 30 bp, Artificial Sequence
  Synthetic
gccagcggcagcttcttgccgggcaacttc

SEQ ID NO: 216 - DNA, 30 bp, Artificial Sequence
  Synthetic
gcacctccagcggcagcttcttgccgggca

SEQ ID NO: 217 - DNA, 30 bp, Artificial Sequence
  Synthetic
gctttgagcacctccagcggcagcttcttg

SEQ ID NO: 218 - DNA, 30 bp, Artificial Sequence
  Synthetic
gcatctctttgagcacctccagcggcagct

SEQ ID NO: 219 - DNA, 30 bp, Artificial Sequence
  Synthetic
gtccatctctttgagcacctccagcggcag

SEQ ID NO: 220 - DNA, 30 bp, Artificial Sequence; identical to SEQ ID NO: 159
  Synthetic

SEQ ID NO: 221 - DNA, 30 bp, Artificial Sequence
  Synthetic
gtccgggcattggcttccatctctttgagc

SEQ ID NO: 222 - DNA, 30 bp, Artificial Sequence
  Synthetic
ggccagctttccgggcattggcttccatct

SEQ ID NO: 223 - DNA, 30 bp, Artificial Sequence
  Synthetic
gggtgcagccagctttccgggcattggctt

SEQ ID NO: 224 - DNA, 30 bp, Artificial Sequence
  Synthetic
gagcccctggtgcagccagctttccgggca

SEQ ID NO: 225 - DNA, 30 bp, Artificial Sequence
  Synthetic
gatcagacagcccctggtgcagccagcttt

SEQ ID NO: 226 - DNA, 30 bp, Artificial Sequence
  Synthetic
ggcagatcagacagcccctggtgcagccag

SEQ ID NO: 227 - DNA, 30 bp, Artificial Sequence
  Synthetic
gacaggcagatcagacagcccctggtgcag

SEQ ID NO: 228 - DNA, 30 bp, Artificial Sequence
  Synthetic
gtgatgtgggacaggcagatcagacagccc

SEQ ID NO: 229 - DNA, 30 bp, Artificial Sequence
  Synthetic
gacttgatgtgggacaggcagatcagacag

SEQ ID NO: 230 - DNA, 30 bp, Artificial Sequence
  Synthetic
ggggcgtgcacttgatgtgggacaggcaga

SEQ ID NO: 231 - DNA, 30 bp, Artificial Sequence
  Synthetic
gcttcatcttgggcgtgcacttgatgtggg

SEQ ID NO: 232 - DNA, 30 bp, Artificial Sequence
  Synthetic
gtgaacttcttcatcttgggcgtgcacttg

SEQ ID NO: 233 - DNA, 30 bp, Artificial Sequence
  Synthetic
gggatgaacttcttcatcttgggcgtgcac

SEQ ID NO: 234 - DNA, 30 bp, Artificial Sequence
  Synthetic
gtgggatgaacttcttcatcttgggcgtgc

SEQ ID NO: 235 - DNA, 30 bp, Artificial Sequence
  Synthetic
gggcagcgtcctgggatgaacttcttcatc

SEQ ID NO: 236 - DNA, 30 bp, Artificial Sequence
  Synthetic
gggtgtggcagcgtcctgggatgaacttct

SEQ ID NO: 237 - DNA, 30 bp, Artificial Sequence
  Synthetic
gttcgtaggtgtggcagcgtcctgggatga

SEQ ID NO: 238 - DNA, 30 bp, Artificial Sequence
  Synthetic
gcgccttcgtaggtgtggcagcgtcctggg

SEQ ID NO: 239 - DNA, 30 bp, Artificial Sequence
  Synthetic
gtctttgtcgccttcgtaggtgtggcagcg

SEQ ID NO: 240 - DNA, 30 bp, Artificial Sequence
  Synthetic
gctttgtcgccttcgtaggtgtggcagcgt

SEQ ID NO: 241 - DNA, 30 bp, Artificial Sequence
  Synthetic
gtgccgccctgtgcggactctttgtcgcct

SEQ ID NO: 242 - DNA, 30 bp, Artificial Sequence
  Synthetic
gtatgccgccctgtgcggactctttgtcgc

SEQ ID NO: 243 - DNA, 30 bp, Artificial Sequence
  Synthetic
gcctcgcctatgccgccctgtgcggactct

SEQ ID NO: 244 - DNA, 30 bp, Artificial Sequence
  Synthetic
ggatcgcctcgcctatgccgccctgtgcgg

SEQ ID NO: 245 - DNA, 30 bp, Artificial Sequence
  Synthetic
gatgtcgacgatcgcctcgcctatgccgcc

SEQ ID NO: 246 - DNA, 30 bp, Artificial Sequence
  Synthetic
gcaggaatgtcgacgatcgcctcgcctatg

SEQ ID NO: 247 - DNA, 30 bp, Artificial Sequence
  Synthetic
gaatctcaggaatgtcgacgatcgcctcgc

SEQ ID NO: 248 - DNA, 30 bp, Artificial Sequence
  Synthetic
gcccaggaatctcaggaatgtcgacgatcg

SEQ ID NO: 249 - DNA, 30 bp, Artificial Sequence
  Synthetic
gccttgaacccaggaatctcaggaatgtcg

SEQ ID NO: 250 - DNA, 30 bp, Artificial Sequence
  Synthetic
gccaagtccttgaacccaggaatctcagga

SEQ ID NO: 251 - DNA, 30 bp, Artificial Sequence
  Synthetic
gtgggctccaagtccttgaacccaggaatc

SEQ ID NO: 252 - DNA, 30 bp, Artificial Sequence
  Synthetic
gccatgggctccaagtccttgaacccagga

SEQ ID NO: 253 - DNA, 30 bp, Artificial Sequence
  Synthetic
ggaactgctccatgggctccaagtccttga

SEQ ID NO: 254 - DNA, 30 bp, Artificial Sequence
  Synthetic
gtgcgatgaactgctccatgggctccaagt

SEQ ID NO: 255 - DNA, 30 bp, Artificial Sequence
  Synthetic
ggacctgtgcgatgaactgctccatgggct

SEQ ID NO: 256 - DNA, 30 bp, Artificial Sequence
  Synthetic
gacagatcgacctgtgcgatgaactgctcc

SEQ ID NO: 257 - DNA, 30 bp, Artificial Sequence
  Synthetic
gacacacagatcgacctgtgcgatgaactg

SEQ ID NO: 258 - DNA, 30 bp, Artificial Sequence
  Synthetic
gtgcagtccacacacagatcgacctgtgcg

SEQ ID NO: 259 - DNA, 30 bp, Artificial Sequence
  Synthetic
gccagttgtgcagtccacacacagatcgac

SEQ ID NO: 260 - DNA, 30 bp, Artificial Sequence
  Synthetic
gggcagccagttgtgcagtccacacacaga

SEQ ID NO: 261 - DNA, 30 bp, Artificial Sequence
  Synthetic
gtttgaggcagccagttgtgcagtccacac

SEQ ID NO: 262 - DNA, 30 bp, Artificial Sequence
  Synthetic
gaagccctttgaggcagccagttgtgcagt

SEQ ID NO: 263 - DNA, 30 bp, Artificial Sequence
  Synthetic
gcacgttggcaagccctttgaggcagccag

SEQ ID NO: 264 - DNA, 30 bp, Artificial Sequence
  Synthetic
gactgcacgttggcaagccctttgaggcag

SEQ ID NO: 265 - DNA, 30 bp, Artificial Sequence
  Synthetic
gggtcagaacactgcacgttggcaagccct

SEQ ID NO: 266 - DNA, 30 bp, Artificial Sequence
  Synthetic
gcaggtcagaacactgcacgttggcaagcc

SEQ ID NO: 267 - DNA, 30 bp, Artificial Sequence
  Synthetic
gagcaggtcagaacactgcacgttggcaag

SEQ ID NO: 268 - DNA, 30 bp, Artificial Sequence
  Synthetic
ggccacttcttgagcaggtcagaacactgc

SEQ ID NO: 269 - DNA, 30 bp, Artificial Sequence
  Synthetic
gcggcagccacttcttgagcaggtcagaac

SEQ ID NO: 270 - DNA, 30 bp, Artificial Sequence
  Synthetic
gtgcggcagccacttcttgagcaggtcaga

SEQ ID NO: 271 - DNA, 30 bp, Artificial Sequence
  Synthetic
gagcgttgcggcagccacttcttgagcagg

SEQ ID NO: 272 - DNA, 30 bp, Artificial Sequence
  Synthetic
gaaaggtcgcacagcgttgcggcagccact

SEQ ID NO: 273 - DNA, 30 bp, Artificial Sequence
  Synthetic
gctggcaaaggtcgcacagcgttgcggcag

SEQ ID NO: 274 - DNA, 30 bp, Artificial Sequence
  Synthetic
gggcaaaggtcgcacagcgttgcggcagcc

SEQ ID NO: 275 - DNA, 30 bp, Artificial Sequence
  Synthetic
gtggatcttgctggcaaaggtcgcacagcg

SEQ ID NO: 276 - DNA, 30 bp, Artificial Sequence
  Synthetic
gcacctggccctggatcttgctggcaaagg

SEQ ID NO: 277 - DNA, 30 bp, Artificial Sequence
  Synthetic
gtggccctggatcttgctggcaaaggtcgc

SEQ ID NO: 278 - DNA, 30 bp, Artificial Sequence
  Synthetic
gtgatcttgtccacctggccctggatcttg

SEQ ID NO: 279 - DNA, 30 bp, Artificial Sequence
  Synthetic
gccccttgatcttgtccacctggccctgga

SEQ ID NO: 280 - DNA, 30 bp, Artificial Sequence
  Synthetic
gcccttgatcttgtccacctggccctggat

SEQ ID NO: 281 - DNA, 30 bp, Artificial Sequence
  Synthetic
gccttgatcttgtccacctggccctggatc

SEQ ID NO: 282 - DNA, 30 bp, Artificial Sequence
  Synthetic
ggcaaaggtcgcacagcgttgcggcagcca

SEQ ID NO: 283 - DNA, 30 bp, Artificial Sequence
  Synthetic
gcaaaggtcgcacagcgttgcggcagccac

SEQ ID NO: 284 - DNA, 30 bp, Artificial Sequence
  Synthetic
gaaggtcgcacagcgttgcggcagccactt

SEQ ID NO: 285 - DNA, 30 bp, Artificial Sequence
  Synthetic
gaggtcgcacagcgttgcggcagccacttc

SEQ ID NO: 286 - DNA, 31 bp, Artificial Sequence
  Synthetic
ggtaatgcctggcttgtcgacgcatagtctg

SEQ ID NO: 287 - DNA, 31 bp, Artificial Sequence
  Synthetic
gggaaccttggccgttataaagtctgaccag

SEQ ID NO: 288 - DNA, 31 bp, Artificial Sequence
  Synthetic
ggagggtgagaatttagaaccaagattgttg

SEQ ID NO: 289 - DNA, 30 bp, Artificial Sequence
  Synthetic
gagtcctggcaatgaacagtggcgcagtag

SEQ ID NO: 290 - DNA, 30 bp, Artificial Sequence
  Synthetic
gggtgccacagctgctatcaatacattctc

SEQ ID NO: 291 - DNA, 30 bp, Artificial Sequence
  Synthetic
gttacatactgacacattcggcaacatgtt

SEQ ID NO: 292 - DNA, 30 bp, Artificial Sequence
  Synthetic
gtatgtaccaggttcctggaactggaatct

SEQ ID NO: 293 - DNA, 30 bp, Artificial Sequence
  Synthetic
gccttggttccatccaggttctccagggtg

SEQ ID NO: 294 - DNA, 30 bp, Artificial Sequence
  Synthetic
gcagtgatgggattctcagtagcttgagcg

SEQ ID NO: 295 - DNA, 30 bp, Artificial Sequence
  Synthetic
gagcctggcatctcaacaacagcgatggtg

SEQ ID NO: 296 - DNA, 30 bp, Artificial Sequence
  Synthetic
gtgtctggggcgattcttacagatcttcct

SEQ ID NO: 297 - DNA, 30 bp, Artificial Sequence
  Synthetic
gctggatctgaagtgaagtctgtatcttcc

SEQ ID NO: 298 - DNA, 30 bp, Artificial Sequence
  Synthetic
ggcaacgtcatcaggatttccatagagtgg

SEQ ID NO: 299 - DNA, 30 bp, Artificial Sequence
  Synthetic
gaggcgcaggagatggtgtagtagtagaag

SEQ ID NO: 300 - DNA, 30 bp, Artificial Sequence
  Synthetic
gagggaccctggaattggtatcttgctttg

SEQ ID NO: 301 - DNA, 30 bp, Artificial Sequence
  Synthetic
ggtaagagtcaacattcctgtgtgaaacct

SEQ ID NO: 302 - DNA, 30 bp, Artificial Sequence
  Synthetic
gaccagaatctgttttccatcaacaatgag

SEQ ID NO: 303 - DNA, 30 bp, Artificial Sequence
  Synthetic
gatggctgtagtcagtatgtcaccatcttg

SEQ ID NO: 304 - DNA, 30 bp, Artificial Sequence
  Synthetic
gtaccatcgaatggatctctaatatgtacg

SEQ ID NO: 305 - DNA, 30 bp, Artificial Sequence
  Synthetic
gagatcacaggctccttcagcatcaaaaga

SEQ ID NO: 306 - DNA, 30 bp, Artificial Sequence
  Synthetic
gctttgaccggcgaagagactattgcagag

SEQ ID NO: 307 - DNA, 30 bp, Artificial Sequence
  Synthetic
gcccctcaggcaatactcgtacatgcatcg

SEQ ID NO: 308 - DNA, 30 bp, Artificial Sequence
  Synthetic
gctggtacttctagggtgtctccatgcttt

SEQ ID NO: 309 - DNA, 31 bp, Artificial Sequence; identical to SEQ ID NO: 286
  Synthetic

SEQ ID NO: 310 - DNA, 31 bp, Artificial Sequence; identical to SEQ ID NO: 287
  Synthetic

SEQ ID NO: 311 - DNA, 31 bp, Artificial Sequence; identical to SEQ ID NO: 288
  Synthetic

SEQ ID NO: 312 - DNA, 31 bp, Artificial Sequence
  Synthetic
gcatcctgcggcctctactctgcattcaatt

SEQ ID NO: 313 - DNA, 31 bp, Artificial Sequence
  Synthetic
gaccatcctgcggcctctactctgcattcaa

SEQ ID NO: 314 - DNA, 31 bp, Artificial Sequence
  Synthetic
gaaaccatcctgcggcctctactctgcattc

SEQ ID NO: 315 - DNA, 31 bp, Artificial Sequence
  Synthetic
gctaaaccatcctgcggcctctactctgcat

SEQ ID NO: 316 - DNA, 31 bp, Artificial Sequence
  Synthetic
gttctaaaccatcctgcggcctctactctgc

SEQ ID NO: 317 - DNA, 31 bp, Artificial Sequence
  Synthetic
gtgttctaaaccatcctgcggcctctactct

SEQ ID NO: 318 - DNA, 31 bp, Artificial Sequence
  Synthetic
gaatgttctaaaccatcctgcggcctctact

SEQ ID NO: 319 - DNA, 31 bp, Artificial Sequence
  Synthetic
gagaatgttctaaaccatcctgcggcctcta

SEQ ID NO: 320 - DNA, 31 bp, Artificial Sequence
  Synthetic
gatagaatgttctaaaccatcctgcggcctc

SEQ ID NO: 321 - DNA, 31 bp, Artificial Sequence
  Synthetic
gccatagaatgttctaaaccatcctgcggcc

SEQ ID NO: 322 - DNA, 31 bp, Artificial Sequence
  Synthetic
gttccatagaatgttctaaaccatcctgcgg

SEQ ID NO: 323 - DNA, 31 bp, Artificial Sequence
  Synthetic
gctttccatagaatgttctaaaccatcctgc

SEQ ID NO: 324 - DNA, 31 bp, Artificial Sequence
  Synthetic
gctctttccatagaatgttctaaaccatcct

SEQ ID NO: 325 - DNA, 31 bp, Artificial Sequence
  Synthetic
gatctctttccatagaatgttctaaaccatc

SEQ ID NO: 326 - DNA, 31 bp, Artificial Sequence
  Synthetic
ggaatctctttccatagaatgttctaaacca

SEQ ID NO: 327 - DNA, 51 bp, Artificial Sequence
  Synthetic
gcatcctgcggcctctactctgcattcaattacatactgacacattcggca

SEQ ID NO: 328 - DNA, 51 bp, Artificial Sequence
  Synthetic
gaccatcctgcggcctctactctgcattcaattacatactgacacattcgg

SEQ ID NO: 329 - DNA, 51 bp, Artificial Sequence
  Synthetic
gaaaccatcctgcggcctctactctgcattcaattacatactgacacattc

SEQ ID NO: 330 - DNA, 51 bp, Artificial Sequence
  Synthetic
gctaaaccatcctgcggcctctactctgcattcaattacatactgacacat

SEQ ID NO: 331 - DNA, 51 bp, Artificial Sequence
  Synthetic
gttctaaaccatcctgcggcctctactctgcattcaattacatactgacac

SEQ ID NO: 332 - DNA, 51 bp, Artificial Sequence
  Synthetic
gtgttctaaaccatcctgcggcctctactctgcattcaattacatactgac

SEQ ID NO: 333 - DNA, 51 bp, Artificial Sequence
  Synthetic
gaatgttctaaaccatcctgcggcctctactctgcattcaattacatactg

SEQ ID NO: 334 - DNA, 51 bp, Artificial Sequence
  Synthetic
gagaatgttctaaaccatcctgcggcctctactctgcattcaattacatac

SEQ ID NO: 335 - DNA, 51 bp, Artificial Sequence
  Synthetic
gatagaatgttctaaaccatcctgcggcctctactctgcattcaattacat

SEQ ID NO: 336 - DNA, 51 bp, Artificial Sequence
  Synthetic
gccatagaatgttctaaaccatcctgcggcctctactctgcattcaattac

SEQ ID NO: 337 - DNA, 51 bp, Artificial Sequence
  Synthetic
gttccatagaatgttctaaaccatcctgcggcctctactctgcattcaatt

SEQ ID NO: 338 - DNA, 51 bp, Artificial Sequence
  Synthetic
gctttccatagaatgttctaaaccatcctgcggcctctactctgcattcaa

SEQ ID NO: 339 - DNA, 51 bp, Artificial Sequence
  Synthetic
gctctttccatagaatgttctaaaccatcctgcggcctctactctgcattc

SEQ ID NO: 340 - DNA, 51 bp, Artificial Sequence
  Synthetic
gatctctttccatagaatgttctaaaccatcctgcggcctctactctgcat

SEQ ID NO: 341 - DNA, 51 bp, Artificial Sequence
  Synthetic
ggaatctctttccatagaatgttctaaaccatcctgcggcctctactctgc

SEQ ID NO: 342 - DNA, 51 bp, Artificial Sequence
  Synthetic
gtggaatctctttccatagaatgttctaaaccatcctgcggcctctactct

SEQ ID NO: 343 - DNA, 51 bp, Artificial Sequence
  Synthetic
gactggaatctctttccatagaatgttctaaaccatcctgcggcctctact

SEQ ID NO: 344 - DNA, 51 bp, Artificial Sequence
  Synthetic
ggaactggaatctctttccatagaatgttctaaaccatcctgcggcctcta

SEQ ID NO: 345 - DNA, 51 bp, Artificial Sequence
  Synthetic
gtggaactggaatctctttccatagaatgttctaaaccatcctgcggcctc

SEQ ID NO: 346 - DNA, 51 bp, Artificial Sequence
  Synthetic
gcctggaactggaatctctttccatagaatgttctaaaccatcctgcggcc

SEQ ID NO: 347 - DNA, 51 bp, Artificial Sequence
  Synthetic
gttcctggaactggaatctctttccatagaatgttctaaaccatcctgcgg

SEQ ID NO: 348 - DNA, 51 bp, Artificial Sequence
  Synthetic
gggttcctggaactggaatctctttccatagaatgttctaaaccatcctgc

SEQ ID NO: 349 - DNA, 51 bp, Artificial Sequence
  Synthetic
gcaggttcctggaactggaatctctttccatagaatgttctaaaccatcct

SEQ ID NO: 350 - DNA, 51 bp, Artificial Sequence
  Synthetic
gaccaggttcctggaactggaatctctttccatagaatgttctaaaccatc

SEQ ID NO: 351 - DNA, 51 bp, Artificial Sequence
  Synthetic
ggtaccaggttcctggaactggaatctctttccatagaatgttctaaacca

SEQ ID NO: 352 - DNA, 71 bp, Artificial Sequence
  Synthetic
gcatcctgcggcctctactctgcattcaattacatactgacacattcggcaacatgtttttcctggtttat

SEQ ID NO: 353 - DNA, 71 bp, Artificial Sequence
  Synthetic
gaccatcctgcggcctctactctgcattcaattacatactgacacattcggcaacatgtttttcctggttt

SEQ ID NO: 354 - DNA, 71 bp, Artificial Sequence
  Synthetic
gaaaccatcctgcggcctctactctgcattcaattacatactgacacattcggcaacatgtttttcctggt

SEQ ID NO: 355 - DNA, 71 bp, Artificial Sequence
  Synthetic
gctaaaccatcctgcggcctctactctgcattcaattacatactgacacattcggcaacatgtttttcctg

SEQ ID NO: 356 - DNA, 71 bp, Artificial Sequence
  Synthetic
gttctaaaccatcctgcggcctctactctgcattcaattacatactgacacattcggcaacatgtttttcc

SEQ ID NO: 357 - DNA, 71 bp, Artificial Sequence
  Synthetic
gtgttctaaaccatcctgcggcctctactctgcattcaattacatactgacacattcggcaacatgttttt

SEQ ID NO: 358 - DNA, 71 bp, Artificial Sequence
  Synthetic
gaatgttctaaaccatcctgcggcctctactctgcattcaattacatactgacacattcggcaacatgttt

SEQ ID NO: 359 - DNA, 71 bp, Artificial Sequence
  Synthetic
gagaatgttctaaaccatcctgcggcctctactctgcattcaattacatactgacacattcggcaacatgt

SEQ ID NO: 360 - DNA, 71 bp, Artificial Sequence
  Synthetic
gatagaatgttctaaaccatcctgcggcctctactctgcattcaattacatactgacacattcggcaacat

SEQ ID NO: 361 - DNA, 71 bp, Artificial Sequence
  Synthetic
gccatagaatgttctaaaccatcctgcggcctctactctgcattcaattacatactgacacattcggcaac

SEQ ID NO: 362 - DNA, 71 bp, Artificial Sequence
  Synthetic
gttccatagaatgttctaaaccatcctgcggcctctactctgcattcaattacatactgacacattcggca

SEQ ID NO: 363 - DNA, 71 bp, Artificial Sequence
  Synthetic
gctttccatagaatgttctaaaccatcctgcggcctctactctgcattcaattacatactgacacattcgg

SEQ ID NO: 364 - DNA, 71 bp, Artificial Sequence
  Synthetic
gctctttccatagaatgttctaaaccatcctgcggcctctactctgcattcaattacatactgacacattc

SEQ ID NO: 365 - DNA, 71 bp, Artificial Sequence
  Synthetic
gatctctttccatagaatgttctaaaccatcctgcggcctctactctgcattcaattacatactgacacat

SEQ ID NO: 366 - DNA, 71 bp, Artificial Sequence
  Synthetic
ggaatctctttccatagaatgttctaaaccatcctgcggcctctactctgcattcaattacatactgacac

SEQ ID NO: 367 - DNA, 71 bp, Artificial Sequence
  Synthetic
gtggaatctctttccatagaatgttctaaaccatcctgcggcctctactctgcattcaattacatactgac

SEQ ID NO: 368 - DNA, 71 bp, Artificial Sequence
  Synthetic
gactggaatctctttccatagaatgttctaaaccatcctgcggcctctactctgcattcaattacatactg

SEQ ID NO: 369 - DNA, 71 bp, Artificial Sequence
  Synthetic
ggaactggaatctctttccatagaatgttctaaaccatcctgcggcctctactctgcattcaattacatac

SEQ ID NO: 370 - DNA, 71 bp, Artificial Sequence
  Synthetic
gtggaactggaatctctttccatagaatgttctaaaccatcctgcggcctctactctgcattcaattacat

SEQ ID NO: 371 - DNA, 71 bp, Artificial Sequence
  Synthetic
gcctggaactggaatctctttccatagaatgttctaaaccatcctgcggcctctactctgcattcaattac

SEQ ID NO: 372 - DNA, 71 bp, Artificial Sequence
  Synthetic
gttcctggaactggaatctctttccatagaatgttctaaaccatcctgcggcctctactctgcattcaatt

SEQ ID NO: 373 - DNA, 71 bp, Artificial Sequence
  Synthetic
gggttcctggaactggaatctctttccatagaatgttctaaaccatcctgcggcctctactctgcattcaa

SEQ ID NO: 374 - DNA, 71 bp, Artificial Sequence
  Synthetic
gcaggttcctggaactggaatctctttccatagaatgttctaaaccatcctgcggcctctactctgcattc

SEQ ID NO: 375 - DNA, 71 bp, Artificial Sequence
  Synthetic
gaccaggttcctggaactggaatctctttccatagaatgttctaaaccatcctgcggcctctactctgcat

SEQ ID NO: 376 - DNA, 71 bp, Artificial Sequence
  Synthetic
ggtaccaggttcctggaactggaatctctttccatagaatgttctaaaccatcctgcggcctctactctgc

SEQ ID NO: 377 - DNA, 71 bp, Artificial Sequence
  Synthetic
gatgtaccaggttcctggaactggaatctctttccatagaatgttctaaaccatcctgcggcctctactct

SEQ ID NO: 378 - DNA, 71 bp, Artificial Sequence
  Synthetic
ggtatgtaccaggttcctggaactggaatctctttccatagaatgttctaaaccatcctgcggcctctact

SEQ ID NO: 379 - DNA, 71 bp, Artificial Sequence
  Synthetic
gacgtatgtaccaggttcctggaactggaatctctttccatagaatgttctaaaccatcctgcggcctcta

SEQ ID NO: 380 - DNA, 71 bp, Artificial Sequence
  Synthetic
gacacgtatgtaccaggttcctggaactggaatctctttccatagaatgttctaaaccatcctgcggcctc

SEQ ID NO: 381 - DNA, 71 bp, Artificial Sequence
  Synthetic
gcaacacgtatgtaccaggttcctggaactggaatctctttccatagaatgttctaaaccatcctgcggcc

SEQ ID NO: 382 - DNA, 71 bp, Artificial Sequence
  Synthetic
gcccaacacgtatgtaccaggttcctggaactggaatctctttccatagaatgttctaaaccatcctgcgg

SEQ ID NO: 383 - DNA, 71 bp, Artificial Sequence
  Synthetic
ggacccaacacgtatgtaccaggttcctggaactggaatctctttccatagaatgttctaaaccatcctgc

SEQ ID NO: 384 - DNA, 71 bp, Artificial Sequence
  Synthetic
gttgacccaacacgtatgtaccaggttcctggaactggaatctctttccatagaatgttctaaaccatcct

SEQ ID NO: 385 - DNA, 71 bp, Artificial Sequence
  Synthetic
gccttgacccaacacgtatgtaccaggttcctggaactggaatctctttccatagaatgttctaaaccatc

SEQ ID NO: 386 - DNA, 71 bp, Artificial Sequence
  Synthetic
gttccttgacccaacacgtatgtaccaggttcctggaactggaatctctttccatagaatgttctaaacca

SEQ ID NO: 387 - DNA, 85 bp, Artificial Sequence
  Synthetic
gcatcctgcggcctctactctgcattcaattacatactgacacattcggcaacatgtttttcctggtttattttcacacagtcca

SEQ ID NO: 388 - DNA, 85 bp, Artificial Sequence
  Synthetic
gaccatcctgcggcctctactctgcattcaattacatactgacacattcggcaacatgtttttcctggtttattttcacacagtc

SEQ ID NO: 389 - DNA, 85 bp, Artificial Sequence
  Synthetic
gaaaccatcctgcggcctctactctgcattcaattacatactgacacattcggcaacatgtttttcctggtttattttcacacag

SEQ ID NO: 390 - DNA, 85 bp, Artificial Sequence
  Synthetic
gctaaaccatcctgcggcctctactctgcattcaattacatactgacacattcggcaacatgtttttcctggtttattttcacac

SEQ ID NO: 391 - DNA, 85 bp, Artificial Sequence
  Synthetic
gttctaaaccatcctgcggcctctactctgcattcaattacatactgacacattcggcaacatgtttttcctggtttattttcac

SEQ ID NO: 392 - DNA, 85 bp, Artificial Sequence
  Synthetic
gtgttctaaaccatcctgcggcctctactctgcattcaattacatactgacacattcggcaacatgtttttcctggtttattttc

SEQ ID NO: 393 - DNA, 85 bp, Artificial Sequence
  Synthetic
gaatgttctaaaccatcctgcggcctctactctgcattcaattacatactgacacattcggcaacatgtttttcctggtttattt

SEQ ID NO: 394 - DNA, 85 bp, Artificial Sequence
  Synthetic
gagaatgttctaaaccatcctgcggcctctactctgcattcaattacatactgacacattcggcaacatgtttttcctggtttat

SEQ ID NO: 395 - DNA, 85 bp, Artificial Sequence
  Synthetic
gatagaatgttctaaaccatcctgcggcctctactctgcattcaattacatactgacacattcggcaacatgtttttcctggttt

SEQ ID NO: 396 - DNA, 85 bp, Artificial Sequence
  Synthetic
gccatagaatgttctaaaccatcctgcggcctctactctgcattcaattacatactgacacattcggcaacatgtttttcctggt

SEQ ID NO: 397 - DNA, 85 bp, Artificial Sequence
  Synthetic
gttccatagaatgttctaaaccatcctgcggcctctactctgcattcaattacatactgacacattcggcaacatgtttttcctg

SEQ ID NO: 398 - DNA, 85 bp, Artificial Sequence
  Synthetic
gctttccatagaatgttctaaaccatcctgcggcctctactctgcattcaattacatactgacacattcggcaacatgtttttcc

SEQ ID NO: 399 - DNA, 85 bp, Artificial Sequence
  Synthetic
gctctttccatagaatgttctaaaccatcctgcggcctctactctgcattcaattacatactgacacattcggcaacatgttttt

SEQ ID NO: 400 - DNA, 85 bp, Artificial Sequence
  Synthetic
gatctctttccatagaatgttctaaaccatcctgcggcctctactctgcattcaattacatactgacacattcggcaacatgttt

SEQ ID NO: 401 - DNA, 85 bp, Artificial Sequence
  Synthetic
ggaatctctttccatagaatgttctaaaccatcctgcggcctctactctgcattcaattacatactgacacattcggcaacatgt

SEQ ID NO: 402 - DNA, 85 bp, Artificial Sequence
  Synthetic
gtggaatctctttccatagaatgttctaaaccatcctgcggcctctactctgcattcaattacatactgacacattcggcaacat

SEQ ID NO: 403 - DNA, 85 bp, Artificial Sequence
  Synthetic
gactggaatctctttccatagaatgttctaaaccatcctgcggcctctactctgcattcaattacatactgacacattcggcaac

SEQ ID NO: 404 - DNA, 85 bp, Artificial Sequence
  Synthetic
ggaactggaatctctttccatagaatgttctaaaccatcctgcggcctctactctgcattcaattacatactgacacattcggca

SEQ ID NO: 405 - DNA, 85 bp, Artificial Sequence
  Synthetic
gtggaactggaatctctttccatagaatgttctaaaccatcctgcggcctctactctgcattcaattacatactgacacattcgg

SEQ ID NO: 406 - DNA, 85 bp, Artificial Sequence
  Synthetic
gcctggaactggaatctctttccatagaatgttctaaaccatcctgcggcctctactctgcattcaattacatactgacacattc

SEQ ID NO: 407 - DNA, 85 bp, Artificial Sequence
  Synthetic
gttcctggaactggaatctctttccatagaatgttctaaaccatcctgcggcctctactctgcattcaattacatactgacacat

SEQ ID NO: 408 - DNA, 85 bp, Artificial Sequence
  Synthetic
gggttcctggaactggaatctctttccatagaatgttctaaaccatcctgcggcctctactctgcattcaattacatactgacac

SEQ ID NO: 409 - DNA, 85 bp, Artificial Sequence
  Synthetic
gcaggttcctggaactggaatctctttccatagaatgttctaaaccatcctgcggcctctactctgcattcaattacatactgac

SEQ ID NO: 410 - DNA, 85 bp, Artificial Sequence
  Synthetic
gaccaggttcctggaactggaatctctttccatagaatgttctaaaccatcctgcggcctctactctgcattcaattacatactg

SEQ ID NO: 411 - DNA, 85 bp, Artificial Sequence
  Synthetic
ggtaccaggttcctggaactggaatctctttccatagaatgttctaaaccatcctgcggcctctactctgcattcaattacatac

SEQ ID NO: 412 - DNA, 85 bp, Artificial Sequence
  Synthetic
gatgtaccaggttcctggaactggaatctctttccatagaatgttctaaaccatcctgcggcctctactctgcattcaattacat

SEQ ID NO: 413 - DNA, 85 bp, Artificial Sequence
  Synthetic
ggtatgtaccaggttcctggaactggaatctctttccatagaatgttctaaaccatcctgcggcctctactctgcattcaattac

SEQ ID NO: 414 - DNA, 85 bp, Artificial Sequence
  Synthetic
gacgtatgtaccaggttcctggaactggaatctctttccatagaatgttctaaaccatcctgcggcctctactctgcattcaatt

SEQ ID NO: 415 - DNA, 85 bp, Artificial Sequence
  Synthetic
gacacgtatgtaccaggttcctggaactggaatctctttccatagaatgttctaaaccatcctgcggcctctactctgcattcaa

SEQ ID NO: 416 - DNA, 85 bp, Artificial Sequence
  Synthetic
gcaacacgtatgtaccaggttcctggaactggaatctctttccatagaatgttctaaaccatcctgcggcctctactctgcattc

SEQ ID NO: 417 - DNA, 85 bp, Artificial Sequence
  Synthetic
gcccaacacgtatgtaccaggttcctggaactggaatctctttccatagaatgttctaaaccatcctgcggcctctactctgcat

SEQ ID NO: 418 - DNA, 85 bp, Artificial Sequence
  Synthetic
ggacccaacacgtatgtaccaggttcctggaactggaatctctttccatagaatgttctaaaccatcctgcggcctctactctgc

SEQ ID NO: 419 - DNA, 85 bp, Artificial Sequence
  Synthetic
gttgacccaacacgtatgtaccaggttcctggaactggaatctctttccatagaatgttctaaaccatcctgcggcctctactct

SEQ ID NO: 420 - DNA, 85 bp, Artificial Sequence
  Synthetic
gccttgacccaacacgtatgtaccaggttcctggaactggaatctctttccatagaatgttctaaaccatcctgcggcctctact

SEQ ID NO: 421 - DNA, 85 bp, Artificial Sequence
  Synthetic
gttccttgacccaacacgtatgtaccaggttcctggaactggaatctctttccatagaatgttctaaaccatcctgcggcctcta

SEQ ID NO: 422 - DNA, 85 bp, Artificial Sequence
  Synthetic
gggttccttgacccaacacgtatgtaccaggttcctggaactggaatctctttccatagaatgttctaaaccatcctgcggcctc

SEQ ID NO: 423 - DNA, 85 bp, Artificial Sequence
  Synthetic
gttggttccttgacccaacacgtatgtaccaggttcctggaactggaatctctttccatagaatgttctaaaccatcctgcggcc

SEQ ID NO: 424 - DNA, 85 bp, Artificial Sequence
  Synthetic
gccttggttccttgacccaacacgtatgtaccaggttcctggaactggaatctctttccatagaatgttctaaaccatcctgcgg

SEQ ID NO: 425 - DNA, 85 bp, Artificial Sequence
  Synthetic
ggcccttggttccttgacccaacacgtatgtaccaggttcctggaactggaatctctttccatagaatgttctaaaccatcctgc

SEQ ID NO: 426 - DNA, 85 bp, Artificial Sequence
  Synthetic
gccgcccttggttccttgacccaacacgtatgtaccaggttcctggaactggaatctctttccatagaatgttctaaaccatcct

SEQ ID NO: 427 - DNA, 85 bp, Artificial Sequence
  Synthetic
gcgccgcccttggttccttgacccaacacgtatgtaccaggttcctggaactggaatctctttccatagaatgttctaaaccatc

SEQ ID NO: 428 - DNA, 85 bp, Artificial Sequence
  Synthetic
ggtcgccgcccttggttccttgacccaacacgtatgtaccaggttcctggaactggaatctctttccatagaatgttctaaacca

SEQ ID NO: 429 - DNA, 30 bp, Artificial Sequence
  Synthetic
gtaatgcctggcttgtcgacgcatagtctg

SEQ ID NO: 430 - DNA, 51 bp, Artificial Sequence
  Synthetic
gaaaacgcaggttcctccagtttcgggagcagcgcacgtctccctgtagtc

SEQ ID NO: 431 - DNA, 51 bp, Artificial Sequence
  Synthetic
gacgcaggttcctctagcttcgggagcagcgcacgtctccctgtagtcaag

SEQ ID NO: 432 - DNA, 30 bp, Artificial Sequence; identical to SEQ ID NO: 429
  Synthetic

SEQ ID NO: 433 - DNA, 51 bp, Artificial Sequence; identical to SEQ ID NO: 335
  Synthetic

SEQ ID NO: 434 - DNA, 30 bp, Artificial Sequence; identical to SEQ ID NO: 429
  Synthetic

SEQ ID NO: 435 - DNA, 51 bp, Artificial Sequence
  Synthetic
gcaaggccacaaaattatccactgtttttggaacagtctttccgaagagac

SEQ ID NO: 436 - DNA, 51 bp, Artificial Sequence
  Synthetic
gcctgtagccaaggccacaaaattatccactgtttttggaacagtctttcc

SEQ ID NO: 437 - DNA, 51 bp, Artificial Sequence
  Synthetic
gctttctctcctgtagccaaggccacaaaattatccactgtttttggaaca

SEQ ID NO: 438 - DNA, 51 bp, Artificial Sequence
  Synthetic
ggccaaatcctttctctcctgtagccaaggccacaaaattatccactgttt

SEQ ID NO: 439 - DNA, 51 bp, Artificial Sequence
  Synthetic
gtttttgtagccaaatcctttctctcctgtagccaaggccacaaaattatc

SEQ ID NO: 440 - DNA, 51 bp, Artificial Sequence
  Synthetic
gatttgctgtttttgtagccaaatcctttctctcctgtagccaaggccaca

SEQ ID NO: 441 - DNA, 51 bp, Artificial Sequence
  Synthetic
gacgatggaatttgctgtttttgtagccaaatcctttctctcctgtagcca

SEQ ID NO: 442 - DNA, 51 bp, Artificial Sequence
  Synthetic
gatagaatgttctaaacgatcctgcggcctctactctgcattcaattacat

SEQ ID NO: 443 - DNA, 51 bp, Artificial Sequence
  Synthetic
gatagaatgttctaaacaatcctgcggcctctactctgcattcaattacat

SEQ ID NO: 444 - DNA, 51 bp, Artificial Sequence
  Synthetic
gatagaatgttctaaactatcctgcggcctctactctgcattcaattacat

SEQ ID NO: 445 - DNA, 51 bp, Artificial Sequence
  Synthetic
ggtcccacgcggcccacagctgcaccaggaagaagggtgcccagcacagca

SEQ ID NO: 446 - DNA, 51 bp, Artificial Sequence
  Synthetic
ggggtcccacgcggcccacagctgcaccaggaagaagggtgcccagcacag

SEQ ID NO: 447 - DNA, 51 bp, Artificial Sequence
  Synthetic
gccgggtcccacgcggcccacagctgcaccaggaagaagggtgcccagcac

SEQ ID NO: 448 - DNA, 51 bp, Artificial Sequence
  Synthetic
gggtgatgacatcccaggcgatcgtgtggcctccaggagcccagagcagga

SEQ ID NO: 449 - DNA, 51 bp, Artificial Sequence
  Synthetic
gagggtgatgacatcccaggcgatcgtgtggcctccaggagcccagagcag

SEQ ID NO: 450 - DNA, 51 bp, Artificial Sequence
  Synthetic
gatcagggtgatgacatcccaggcgatcgtgtggcctccaggagcccagag

SEQ ID NO: 451 - DNA, 51 bp, Artificial Sequence
  Synthetic
ggtggctccattcactccaatgctgagcacttccacagagtgggttaaagc

SEQ ID NO: 452 - DNA, 51 bp, Artificial Sequence
  Synthetic
gtttctaatatattttgccagactgatggactattctcaattaataatgat

SEQ ID NO: 453 - DNA, 51 bp, Artificial Sequence
  Synthetic
gagatgttgctgtggatccagtccacagccagcccgtcgggggcctggatg

SEQ ID NO: 454 - DNA, 51 bp, Artificial Sequence
  Synthetic
gcaggccggcccagctgccaggtgcacctgctcggagcatcgggccggatc

SEQ ID NO: 455 - DNA, 51 bp, Artificial Sequence
  Synthetic
gcaaagaacctctgggtccaagggtagaccaccagcagcctgcccagggcc

SEQ ID NO: 456 - DNA, 51 bp, Artificial Sequence
  Synthetic
gaagagaaacttagtttccagggctttggtagagggcaaaggttgatagca

SEQ ID NO: 457 - DNA, 51 bp, Artificial Sequence
  Synthetic
gtcagcctagtgcagagccactggtagttggtggttagagtttcaagttcc

SEQ ID NO: 458 - DNA, 51 bp, Artificial Sequence
  Synthetic
ggctcattgtgaacaggccagtaatgtccgggatggggcggcataggcggg

SEQ ID NO: 459 - DNA, 51 bp, Artificial Sequence
  Synthetic
gtagctaaagaacttgaccaagacatatcaggatccacctcagctcctaga

SEQ ID NO: 460 - DNA, 51 bp, Artificial Sequence
  Synthetic
ggggcattgttctgtgcccagtcctgctggtagacctgctccccggtggct

SEQ ID NO: 461 - DNA, 51 bp, Artificial Sequence
  Synthetic
gagaagtcgttcatgtgccaccgtgggagcgtacagtcatcattgatcttg

SEQ ID NO: 462 - DNA, 51 bp, Artificial Sequence
  Synthetic
gggattaatgctgaacgcaccaaagttcatcccaccacccatattactacc

SEQ ID NO: 463 - DNA, 51 bp, Artificial Sequence
  Synthetic
gctccaaaggctttcctccactgttgcaaagttattgaatcccaagacaca

SEQ ID NO: 464 - DNA, 51 bp, Artificial Sequence
  Synthetic
gatgaatgaacgatttcccagaactccctaatcagaacagagtccctggta

SEQ ID NO: 465 - DNA, 51 bp, Artificial Sequence
  Synthetic
ggagcctctgccggagcccagagaacccgagagtcagacagagccagcgcc

SEQ ID NO: 466 - DNA, 51 bp, Artificial Sequence
  Synthetic
ggcttccgtggagacacccaatcaatttgaagagatcttgaagtgatgcca

SEQ ID NO: 467 - DNA, 51 bp, Artificial Sequence
  Synthetic
gtgggactgccctcctcccatttgcagatgccgtcgtagaatcgcagcagg

SEQ ID NO: 468 - DNA, 51 bp, Artificial Sequence
  Synthetic
gcttcttcaatagttctccagctacactggcaggcatatgcccgtgttcct

SEQ ID NO: 469 - DNA, 51 bp, Artificial Sequence
  Synthetic
gattccttttcttcgtcccaattcacctcagtggctagtcgaagaatgaag

SEQ ID NO: 470 - DNA, 51 bp, Artificial Sequence
  Synthetic
gcagcttcagcaccttccagtcagactcctgcttcaagcactgcagcagga

SEQ ID NO: 471 - DNA, 51 bp, Artificial Sequence
  Synthetic
gccatttgcttgcagtgccactccagaggattccggattgccataaatact

SEQ ID NO: 472 - DNA, 51 bp, Artificial Sequence
  Synthetic
gttcaatagttttggtccagtatcgtttacagcccttcttggtagatttca

SEQ ID NO: 473 - DNA, 51 bp, Artificial Sequence
  Synthetic
ggcaaccgtcttctgaccaaatggcagaacatttgtccccaactttccact

SEQ ID NO: 474 - DNA, 51 bp, Artificial Sequence
  Synthetic
gcgactttccaatgaaccactgaagcccaggtatgacaaagccgatgatct

SEQ ID NO: 475 - DNA, 51 bp, Artificial Sequence
  Synthetic
gtttacactcatgcttccacagctttaacagatcatttggttccttgatga

SEQ ID NO: 476 - DNA, 51 bp, Artificial Sequence
  Synthetic
gcttaagcttccgtgtccagccttcaggcagggtggggtcatcatacatgg

SEQ ID NO: 477 - DNA, 51 bp, Artificial Sequence
  Synthetic
ggacagctgggctgatccatgatgtcatccagaaacactggggaccctcag

SEQ ID NO: 478 - DNA, 51 bp, Artificial Sequence
  Synthetic
gtctcatctcaactttccatatccgtatcatggaatcatagcatcctgtaa

SEQ ID NO: 479 - DNA, 51 bp, Artificial Sequence
  Synthetic
gcatgcagacgcggttccactcgcagccacagttccagcaccactcgagcc

SEQ ID NO: 480 - DNA, 51 bp, Artificial Sequence
  Synthetic
gttggttagggtcaacccagtattctccactcttgagttcaggatggcaga

SEQ ID NO: 481 - DNA, 51 bp, Artificial Sequence
  Synthetic
gctacactgtccaacacccactctcgggtcaccacaggtgcctcacacatc

SEQ ID NO: 482 - DNA, 51 bp, Artificial Sequence
  Synthetic
gctgcactgtgtacccccagagctccgtgttgccgacatcctggggtggct

SEQ ID NO: 483 - DNA, 51 bp, Artificial Sequence
  Synthetic
gagcttcctgccactcccaacaggtttcacagtaagcgcgtatctgttcca

SEQ ID NO: 484 - DNA, 51 bp, Artificial Sequence
  Synthetic
gacggcaagagcttacccagtcacttgtgtggagacttaaatacttgcata

SEQ ID NO: 485 - DNA, 51 bp, Artificial Sequence; identical to SEQ ID NO: 435
  Synthetic

SEQ ID NO: 486 - DNA, 51 bp, Artificial Sequence; identical to SEQ ID NO: 436
  Synthetic

SEQ ID NO: 487 - DNA, 51 bp, Artificial Sequence; identical to SEQ ID NO: 437
  Synthetic

SEQ ID NO: 488 - DNA, 51 bp, Artificial Sequence; identical to SEQ ID NO: 438
  Synthetic

SEQ ID NO: 489 - DNA, 51 bp, Artificial Sequence; identical to SEQ ID NO: 439
  Synthetic

SEQ ID NO: 490 - DNA, 51 bp, Artificial Sequence; identical to SEQ ID NO: 440
  Synthetic

SEQ ID NO: 491 - DNA, 51 bp, Artificial Sequence; identical to SEQ ID NO: 441
  Synthetic

SEQ ID NO: 492 - DNA, 30 bp, Artificial Sequence; identical to SEQ ID NO: 429
  Synthetic

SEQ ID NO: 493 - DNA, 51 bp, Artificial Sequence; identical to SEQ ID NO: 335
  Synthetic

SEQ ID NO: 494 - DNA, 34 bp, Artificial Sequence
  Synthetic
gcagggttttcccagtcacgacgttgtaaagttg

SEQ ID NO: 495 - DNA, 51 bp, Artificial Sequence
  Synthetic
gtcaaggcactcttgcccacgccaccagctccaactaccacaagtttatat

SEQ ID NO: 496 - DNA, 51 bp, Artificial Sequence
  Synthetic
gcaaagatcacccggcccacatcttcatctccaattcgtaggtcaaaatac

SEQ ID NO: 497 - DNA, 51 bp, Artificial Sequence
  Synthetic
gcgccaccagctccaaccaccacaagtttatattcagtcattttcagcagg

SEQ ID NO: 498 - DNA, 51 bp, Artificial Sequence
  Synthetic
gtttctccatcaattaccacttgcttcctgtaggaatcctctattgttgga

SEQ ID NO: 499 - DNA, 51 bp, Artificial Sequence; identical to SEQ ID NO: 437
  Synthetic

SEQ ID NO: 500 - DNA, 30 bp, Artificial Sequence; identical to SEQ ID NO: 429
  Synthetic

SEQ ID NO: 501 - DNA, 83 bp, Artificial Sequence
  Synthetic
tctttccataggccctgaaaaagggcctgttctaaaccatcctgcggcctctactcggccctgaaaaagggccattcaattac

SEQ ID NO: 502 - DNA, 83 bp, Artificial Sequence
  Synthetic
cagctggcgaggccctgaaaaagggccggggatgtgccgcaaggcgattaagttggggccctgaaaaagggccacgccagggt

SEQ ID NO: 503 - DNA, 79 bp, Artificial Sequence
  Synthetic
gtggaatagtataacaatatgctaaatgttgttatagtatcccactctaaaccatcctgcggggccctcttcagggccc

SEQ ID NO: 504 - DNA, 79 bp, Artificial Sequence
  Synthetic
gtggaatagtataacaatatgctaaatgttgttatagtatcccacaccctggcgttacccagggccctcttcagggccc

SEQ ID NO: 505 - RNA, 45 nt, Cypridina luciferase
auugaaugcagaguagaggccgcaggauaguuuagaacauucuau

SEQ ID NO: 506 - RNA, 66 nt, Cypridina luciferase
ucuaaaccauccugcggccucuacucugcaguuguggaagguccaguuuugggggcuauuacaaca

SEQ ID NO: 507 - DNA, 105 bp, Artificial Sequence
  Synthetic
tgccgaaugugucaguauguaauugaaugcagaguagaggccgcaggauaguuuagaacauucuauggaaagagauuccaguuccaggaaccugguacauacgug

SEQ ID NO: 508 - RNA, 65 nt, Homo sapiens
ucgucuaugugcugugcugggcacccuucuuccuggugcagcuguaggccgcgugggacccggag

SEQ ID NO: 509 - RNA, 50 nt, Artificial Sequence
  Synthetic
gucccacgcggcccacagcugcaccaggaagaagggugcccagcacagca

SEQ ID NO: 510 - RNA, 49 nt, Artificial Sequence
  Synthetic
gggucccacgcggcccacagugcaccaggaagaagggugcccagcacag

SEQ ID NO: 511 - RNA, 50 nt, Artificial Sequence
  Synthetic
ccgggucccacgcggcccacagcugcaccaggaagaagggugcccagcac

SEQ ID NO: 512 - RNA, 65 nt, Homo sapiens
ccucaacuuccugcucugggcuccuggaggccacacgaucgccuaggaugucaucacccugauug

SEQ ID NO: 513 - RNA, 50 nt, Artificial Sequence
  Synthetic
ggugaugacaucccaggcgaucguguggccuccaggagcccagagcagga

SEQ ID NO: 514 - RNA, 50 nt, Artificial Sequence
  Synthetic
agggugaugacaucccaggcgaucguguggccuccaggagcccagagcag

SEQ ID NO: 515 - RNA, 50 nt, Artificial Sequence
  Synthetic
aucagggugaugacaucccaggcgaucguguggccuccaggagcccagag

SEQ ID NO: 516 - RNA, 99 nt, Unknown
  Synthetic
cccaggugcgggagagaggccugcugaaaaugacugaauauaaacuugugguaguuggagcugguggcguaggcaagagugccuugacgauacagcuaa

SEQ ID NO: 517 - RNA, 50 nt, Artificial Sequence
  Synthetic
caccacaaguuuauauucagucauuuucagcaggccucucucccgcaccu

SEQ ID NO: 518 - RNA, 50 nt, Artificial Sequence
  Synthetic
gcuccaaccaccacaaguuuauauucagucauuuucagcaggccucucuc

SEQ ID NO: 519 - RNA, 49 nt, Artificial Sequence
  Synthetic
cgccaccagcuccaaccccacaaguuuauauucagucauuuucagcagg

SEQ ID NO: 520 - RNA, 50 nt, Artificial Sequence
  Synthetic
cuugccuacgccaccagcuccaaccaccacaaguuuauauucagucauuu

SEQ ID NO: 521 - RNA, 50 nt, Artificial Sequence
  Synthetic
aaggcacucuugccuacgccacagcuccaaccaccacaaguuuuauauuc

SEQ ID NO: 522 - DNA, 49 bp, Artificial Sequence
  Synthetic
guatcgucaaggcacucuugccuacgccaccaguccaaccaccacaagu

SEQ ID NO: 523 - RNA, 50 nt, Artificial Sequence
  Synthetic
aauuagcuguaucgucaaggcacucuugccuacgccaccagcuccaacca

SEQ ID NO: 524 - DNA, 44 bp, Cypridinia luciferase
tatgtaattgaatgcagagtagaggccgcaggatagtttagaac

SEQ ID NO: 525 - DNA, 44 bp, Cypridinia luciferase; identical to SEQ ID NO: 524

SEQ ID NO: 526 - RNA, 38 nt, Unknown
  Synthetic
  misc_feature (4)..(5): n is a, c, g, or u
  misc_feature (36)..(38): n is a, c, g, or u
augnnuugccaccgacgacaccgugaggauaaauunnn

SEQ ID NO: 527 - RNA, 36 nt, Homo sapiens
uggaggugcucaaagagauggaagccaaugcccgga

SEQ ID NO: 528 - RNA, 36 nt, Artificial Sequence
  Synthetic
  misc_feature (1)..(1): n is a, c, g, or u
nggaggugcucaaagagauggaagccaaugcccgga

SEQ ID NO: 529 - RNA, 36 nt, Artificial Sequence
  Synthetic
  misc_feature (2)..(2): n is a, c, g, or u
ungaggugcucaaagagauggaagccaaugcccgga

SEQ ID NO: 530 - RNA, 35 nt, Artificial Sequence
  Synthetic
  misc_feature (3)..(3): n is a, c, g, or u
ugnaggugcucaaagagauggaagccaaugccgga

SEQ ID NO: 531 - RNA, 35 nt, Artificial Sequence
  Synthetic
  misc_feature (4)..(4): n is a, c, g, or u
uggnggugcucaaagagauggaagccaaugccgga

SEQ ID NO: 532 - RNA, 35 nt, Artificial Sequence
  Synthetic
  misc_feature (18)..(18): n is a, c, g, or u
uggaggugcucaaagagnuggaagccaaugccgga

SEQ ID NO: 533 - RNA, 35 nt, Artificial Sequence
  Synthetic
  misc_feature (35)..(35): n is a, c, g, or u
uggaggugcucaaagagauggaagccaaugccggn

SEQ ID NO: 534 - RNA, 36 nt, Artificial Sequence
  Synthetic
  misc_feature (1)..(2): n is a, c, g, or u
nngaggugcucaaagagauggaagccaaugcccgga

SEQ ID NO: 535 - RNA, 36 nt, Artificial Sequence
  Synthetic
  misc_feature (1)..(1): n is a, c, g, or u
  misc_feature (3)..(3): n is a, c, g, or u
ngnaggugcucaaagagauggaagccaaugcccgga

SEQ ID NO: 536 - RNA, 36 nt, Artificial Sequence
  Synthetic
  misc_feature (1)..(1): n is a, c, g, or u
  misc_feature (4)..(4): n is a, c, g, or u
nggnggugcucaaagagauggaagccaaugcccgga

SEQ ID NO: 537 - RNA, 36 nt, Artificial Sequence
  Synthetic
  misc_feature (1)..(1): n is a, c, g, or u
  misc_feature (5)..(5): n is a, c, g, or u
nggangugcucaaagagauggaagccaaugcccgga

SEQ ID NO: 538 - RNA, 37 nt, Artificial Sequence
  Synthetic
  misc_feature (15)..(15): n is a, c, g, or u
  misc_feature (19)..(19): n is a, c, g, or u
uggaggugcucaaangagnuggaagccaaugcccgga

SEQ ID NO: 539 - RNA, 36 nt, Artificial Sequence
  Synthetic
  misc_feature (35)..(36): n is a, c, g, or u
uggaggugcucaaagagauggaagccaaugcccgnn

SEQ ID NO: 540 - RNA, 56 nt, Cypridinia luciferase
aguauguaauugaaugcagaguagaggccgcaggauaguuuagaacauucuaugga

SEQ ID NO: 541 - RNA, 50 nt, Artificial Sequence
  Synthetic
  misc_feature (17)..(17): n at position 17 is empty
  misc_feature (34)..(34): n at position 34 is empty
auagaauguucuaaacnauccugcggccucuacucugcauucaauuacau

SEQ ID NO: 542 - RNA, 59 nt, Artificial Sequence
  Synthetic
auguaauugaaugcagaguagaggccgcaggauaguuuagaacauucuauggaaagaga

SEQ ID NO: 543 - RNA, 83 nt, Artificial Sequence
  Synthetic
ucuuuccauaggcccugaaaaagggccuguucuaaaccauccugcggccucuacucggcccugaaaaagggccauucaauuac

SEQ ID NO: 544 - RNA, 21 nt, Artificial Sequence
  Synthetic
ggccgcaggauaguuuagaac

SEQ ID NO: 545 - RNA, 54 nt, Artificial Sequence
  Synthetic
aaauguuguuauaguaucccaccucuaaaccauccugcgggcccuagggcccuu

SEQ ID NO: 546 - RNA, 26 nt, Artificial Sequence
  Synthetic
accgguggaauaguauaacaauaugc

What is claimed:

1. An engineered composition comprising:
   i) a Cas13b effector protein comprising the amino acid sequence of SEQ ID NO:32, and
   ii) an engineered guide RNA,
   wherein the engineered guide RNA is capable of forming a CRISPR-Cas complex with the Cas13b effector protein and comprises a) a guide sequence that directs sequence specific binding to a target RNA sequence other than a naturally occurring *Prevotella intermedia* Cas13b protospacer and that reprograms the CRISPR-Cas complex to bind said target RNA sequence, and b) a direct repeat sequence.

2. The engineered composition of claim 1, which comprises an accessory protein that enhances the activity of the Cas13b effector protein or represses activity of the Cas13b effector protein.

3. The engineered composition of claim 2, wherein the accessory protein that enhances the activity of the Cas13b effector protein is a csx28 protein.

4. The engineered composition of claim 2, wherein the accessory protein that represses the activity of the Cas13b effector protein is a csx27 protein.

5. The engineered composition of claim 1, which comprises two or more engineered guide RNAs.

6. The engineered composition of claim 1, wherein the engineered guide RNA hybridizes to a target RNA sequence in a prokaryotic cell.

7. The engineered composition of claim 1, wherein the engineered guide RNA hybridizes to a target RNA sequence in a eukaryotic cell.

8. The engineered composition of claim 1, wherein the Cas13b effector protein comprises one or more nuclear localization signals (NLSs).

9. The engineered composition of claim 2, wherein the Cas13b effector protein and the accessory protein are from the same organism.

10. The engineered composition of claim 2, wherein the Cas13b effector protein and the accessory protein are from different organisms.

* * * * *